United States Patent 7,745,391 (HUMAN THROMBOSPONDIN POLYPEPTIDE) - sequence listing, part 38

SEQ ID NO: 88218 - DNA, 908 bp, Homo sapiens
agatggtaagttccaatttttccggtgatgggagttaaagtgtgaacaggaactggatataaagggccacacttcagggtatcccaggtctgctttctccccagaatcctaatttgctgcttactggatggaatcgatggggaagatcacgttcgtgggatgcaaacagtgaagttgagagaaaatacagaagagtcccacaatcacgtacccacaggaatgagaacctataaagaggaacttgcaccaagtcagggtggaaatactaacgcttcagtaacagatgaggaagaacatggcaacattttaccgaagctaaatattgaacatggagaaaaagtgaactggctcttggggtacaaaaataaagggacaccaaatgctgggattacaggtgtgagccaccacgcccagcctaattctctttttctaatagttgcactttatcatattttacaaatgtgtgagtctgctatggattagaaattaataagagattttgccacagatagtttgagaagcccagcactgccactcaacaaatgctggtgcattcagatggtgaaatattctgcagctattaaaggagttaaaactgcctccacttacctggaggcccatctgtgacacctttttaggttaaaaggaaaagaaaaacttgcttaggactgaatatgagcggttgcaatttgtaacaatgatgtatatatacatatacattttcatgtatttgtatgaacataaaagtattgaaggatattcatcaaactgctaaaagggttgcttcagagtaacggactcggagaaggcagattaattttctcttaatggaactctgtattgtatcacttgtaaaaataagcatgtgttatctttatgataaaaaagtaaaaacctaaaaaagaaaa

SEQ ID NO: 88219 - DNA, 596 bp, Homo sapiens
ttcaccatgttagccaggatggtctcaatctcctgatctcgtgatctgcccgccttggcctcccaaaatgctgggattacaggtgtgagccaccacgcccagcctaattctctttttctaatagttgcactttatcatattttacaaatgtgtgagtctgctatggattagaaattaataagagattttgccacagatagtttgagaagcccagcactgccactcaacaaatgctggtgcattcagatggtgaaatattctgcagctattaaaggagttaaaactgcctccacttacctggaggcccatctgtgacacctttttaggttaaaaggaaaagaaaaacttgcttaggactgaatatgagcggttgcaatttgtaacaatgatgtatatatacatatacattttcatgtatttgtatgaacataaaagtattgaaggatattcatcaaactgctaaaagggttgcttcagagtaacggactcggagaaggcagattaattttctcttaatggaactctgtattgtatcacttgtaaaaataagcatgtgttatctttatgataaaaaagtaaaaacctaaaaaagaaaa

SEQ ID NO: 88220 - DNA, 1313 bp, Homo sapiens
ttcaccatgttagccaggatggtctcaatctcctgatctcgtgatctgcccgccttggcctcccaaaatgctgggattacaggtgtgagccaccacgcccagcctaattctctttttctaatagttgcactttatcatattttacaaatgtgtgagtctgctatggattagaaattaataagagattttgccacagatagtttgagaagcccagcactgccactcaacaaatgctggtgcattcagatggtgaaatattctgcagctattaaaggagttaaaactgcctccacttacctggaggcccatctgtgacacctttttaggttaaaaggaaaagaaaaacttgcttaggactgaatatgagcggttgcaatttgtaacaatgatgtatatatacatatacattttcatgtatttgtatgaacataaaagtattgaaggatattcatcaaactgctaaaagggttgcttcagagtaacggactcggagaaggcagattaattttctcttaatggaactctgtattgtatcacttgtaaaaataagcatgtgttatctttatgataaaaaagtaaaaacctaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaagagaaggggggaaggaagaactaacatgaagacgcgggggccacaaacaatcaacacccgcgagcagaacaatctagtaaggaagacgagctgaccctcgaagagaacagacaatataacaaaaatcgagcacgtcgcgcaaggcgctaggaaaacacatacagagaacgacaaacaaaaccgccaccggaacgataacacggcagcaaacacacaacccccatctggtgtgagtcaagcgaaaaacaccgagcagcacaacaaaacacgcacatcaagcgcaggagaaccacaaaaaaacaaacagtcagagtgaagagtagaacaaccaacacaagcctcagcgccagggacgaagaaaagagtccaagcagtcagcctaaacaaaaacaacaacggcacggacgcacatacacaccctgcccaactagaaaaggagaggagccagcgcagaccgacagacagagaacaggatgaggaccacaaacataaggccacacgccaccaagaccaaccacagcacccccaccgaacaccggcgccgcacgaacggacacgcgaaacaaca

SEQ ID NO: 88221 - DNA, 618 bp, Homo sapiens
agagcttcatcagaaggccaaaaaggcctacctatgaataatattcattctaaagagtaagaataggtaaggaataagaccaccttgatgctgtgatgatgcttttctataatacaaatatttggtcaatgctctttctccaaaagcttgctttctagattttacctggaaatttctaggaccctgcaaatccttgcgaaagtcaaaagagggaaacggcctaattctctctcatttaccatgcaccacctaggtgaaacaagaagttctgcaaattactcactgtttttatttacccctgctgggctccttgtaagccttcctgggtttgttatactctgaaatatggagcattaatgaccttttaggaagtgccagcacatgtcaggaggtggctacttgctctgctcgccataaaaaagggtgttaataggctccaaagggggccctcagttaggaaaatagtacttcaagcctttattaacggactgctatcttgtagggggatccaaagtgataagccctcaatttgaagaaaggctacattctagaacaagggaaagaagacactaatggggtccttttacaatttgaattagatgtgtgaccttgtaaagc

SEQ ID NO: 88222 - DNA, 781 bp, Homo sapiens
ttcaagcctgtagtgcactatgatcatgcctgtggatagccagcctggcaacatagcaagatcttatcactacaaaacaaacaaaaagaggttagaaaaggaacacaaaatgtgatggttaatactgagtgtcaacttgattggatcgaagcatacaaagtattgttcctgagtgtgtctttgggagtgttgccaaaggagattaacatttgagtcagtggactgggagaggctgacccaccctcagtctgggtgggcaccatctaatcagctgccagcataaaaacagaaatggaaagagcagacttgctgagtcttctggcctccatctttctcccgtgctggatatttctgccctcaaacagcagactccaagttcttcagcttttggactcttggacctataccagtggttcaccaagggctcttcagccttcagtcacagactggaggctgcactgtcagcttctctacttttgaggttttgggactcaaactggcttccttgctcttcagcttgcaaacagcctgttgtgggacttcaccttgtgaccgttcatcttcttagagaataaataagaaaaacgtatggaatgatattgtggttaatacaatgtaagagatcacacgacagactccaaagaaggcatagactgataatataaacaataagtgctggaagagttgaagaggtagctgtatcccttggaggaggtgttcagatgatacgtcaagtagaaacttggaccttgaagatgaatgtaagaggagtgggaaatca

SEQ ID NO: 88223 - DNA, 254 bp, Homo sapiens
ccttccataaacagaacaactcattcatcaaaatagtttgttataaccgaatcaatggcccacttattggaaaagtgctaaacacaaagaatttcattgaaatcaaattttctgagctggctctataaagtaagtgcaataactacatttgttcataagtaatgacataatggcaaaactactaccaaaagtgtaaattctcctaacaaaactagtcaagaaataaaaaaaaaaaaaaaagtaggaccagcttt

SEQ ID NO: 88224 - DNA, 4588 bp, Homo sapiens
  misc_feature (2767)..(2767): n is a, c, g, or t
  misc_feature (3036)..(3036): n is a, c, g, or t
  misc_feature (3091)..(3091): n is a, c, g, or t
ttaattgaagaaacactgagctgaactacaagtctatttcttatggtgctggattactcctacagaactgccctgagatcaaccgtgagagagggctctgacagacacaagtcaccttcttattgcacttagctctccctggggacttaaattttggcagtgttcctctttacatgatatcctccaagatgatgagttctaatcctgaggaagaccctttggacacatttctccagtacattgaggatatggggatgaaggcctacgatggcttggttattcagaatgcgtcagatattgctcgagagaatgatcgcttgagaaatgaaactaacctagcctatttgaaagagaagaatgaaaaacgccgaagacaagaagaagcaataaagcgcataggtggagaagtagggcgaggccacgaaggaagttacgtgggcaaacatttccgcatgggattcatgacaatgcctgctcctcaggacagacttccccatccttgctccagtggcttttctgtgagatcacagtccctgcactcggttgggggcacagacgatgacagcagctgtggctcacggagacaaccaccacccaaacccaagagggaccccagcaccaagctgagcacctcatcagagacagtcagcagcactgcagccagtaagagcgggaaaacccctgagaggactgaagcgtcagctaaaccaagaccccacagcgatgaatattccaagaagattcctcctcccaaaccgaagcgaaatccgaacactcagctgagcacatctttcgatgaaacgtacatcaaaaagcatgggccccggaggacgtcgctgccgcgggactcctccttgtcccagatgggcagccccgcgggagaccccgaggaagaggagcccgtgtacatcgagatggtggggaacattctcagagacttcaggaaggaggacgatgaccagagcgaggccgtctacgaggaaatgaagtaccctatctttgacgacttgggccaagacgccaaatgtgacttcgaccatcacagctgttcttcgcagtgtgctactcccacggtgcctgacttggacttcgccaaggcctcagtgccatgcccccccaaggggctgctttgcgacatccctccgcccttccccaacctgctttctcacagacccccgctgctggtatttccccccgcccccgtgcattgctcccccaactccgacgagtccccgcttacccctctggaggtcacgaagcttcccgtgctggaaaacgtgtcttacatgaaacagccagccggggcgtcgccctccacgctgccgtcccacgtccccggccatgcgaaactggagaaagagcaggccgcggccctgggacctgcctctgccacccctgcgctctcctcgtcgcccccacccccgtctacgctgtaccgaacccagtctccccatggctaccctaaaagtcactccacctctccctcccccgtcagcatggggaggtccctgactcccctgagcctcaaaaggcctcccccttacgacgctgtgcattcgggcagcctctcaaggagctctccttcagtgcctcactcgacccccagacccgtgtcgcaagatggggccaagatggtcaacgccgcggtgaacacctacggggcagccccgggtggctcccggtcccggacacccacgagcccgctggaggagctgaccagcctcttctcctccggccgcagcctgctgcgcaagtcgtccagtggccggcgctccaaagagcctgcagagaaatcaacagaggaactgaaagtccgaagccacagcacggagccattaccaaagttggacaacaaggaaagaggccaccatggggcgtcttcctccagagagcctgtcaaagctcaggaatgggatggaacaccagggccacctgtggtcaccagtcgactaggaagatgctctgtgagccccaccttgttagcgggaaaccacagttcagagcctaaagtaagctgcaaattaggccggtctgcgtcgacgtcaggtgtgcctcctccatcagtcactcccctcaggcaaagcagtgacctgcaacagagccaggtaccatcatcgttagccaatcgtgattgacttcctgtgatacaacttgccaaatgcttcccacctctgtctgtcctgttgctgtagacaactttcgcatttgcttttatttttctatgtgtgtatgggttaggggatgcgggggatgagttctggcagtctgtgttttcatttgaaaaagaatatctttcttccttgtgattggtggtgaaactttctttgctgtttgttaccaaatcgtttttgtctctggtttccatcattctgtaatataaatgtagtaaacttgtactatatgtattggcttagtggttcttttttaaattctttctctctttcatgttttgtgtacttttatactgtctctgaaaatttatcaatatttgataaatttatctactttgttttatgtagatttctttttaaatgttttgtccagaacactcgcacagatgttgtcaatgaatttgtacatatttcttagctcttatcctattatactgtaatatttctggtggttttatttttatttagcttggagcatgactgtaagacactgttgaatattgatgtccttataaatattcatatcccgattcatttggattgagtatggcagctagtctttcttctttcttaggctattgactggcctaagacantttgactggccagacaaattgactggccagataatctagatatttaacaaaaactgcagattaataaggcaacctttaaatgaatgacttttctctcttataccaacaatatcagaaatgttctcagaaagggaatgtaagtgttcatgcatggtaaatgagatctcaattatcacttggagaaaagagacaagaaataaaggcataaactgaaatatcatttaatcctttacagcataatatgttgctctgatgttcgtttgggtacntggttgtggatggggaattagtatggggaaaaatcactacacataaatgtcctanctttagctcacccaataggaattcaatacattgacttaatttgtgaggcttaattgtcgttactgttaagtattataggtgttaagtagggtggtgtcattctggaatgttttctctctgcttcctagcttcaatctttgcattcatgaaactcttctgaaatagcaacttataaaacactgatgatacctccaagggaactgcccattactgatgagaaaattacatattcatctattattttaaatgtcaggctattttaaaaacataactaagtagaataattgcgttttcttctaatgagagacattgtgcctcttagtgtttttgtctgacttaaatatgcaaaatagttgatttataaatatatgaggtatctgcaaatacaagaaatgagaggcttctctcaagggtatctcaagtaccatttagaatttcttgtgtcttaatttaaaatttaaatgcctttatataaatgttaaatgcctttataactaaatgtaccaactcaaacactttttggatataaaagaagtagaaacagtaagacactgaataaaataaataagataaactgccaacttagctaattaaagctattccaaaaatattgtacttaccaacatttaaagcttaaaaacattgggtactgaaagaagagaagtttagctaattggcagaggattgcactaatacaatcaagttttcaagtttatgacccttgctagtatattaccttcaatatctcagagatgttttgtattatttgttttgttttgcttttttcctagttgtctttatagctgtttcaccctaagccccttcaaactctcaatgaaagcaggttcttgggataaacttccagaatagagacaaggtataccctttgtgcctttgcattatcaactctttgttcacctgatgggaagttcttcgtttttcaaaatgtagcaagggagaaagcccaggacgcctttatatgctgttagtttccttacctgctgatagagattctgacacacagtcaaatcatacatgggctgtcagagctataaattagaaggctggcctctaggcttctcctctgtggcttatagccagttgtaatatacatgcattcctatactctagagatgaagtggtaagcatagctcatatgaacactgctctgaactcctctgacttagcattcaacttaagtcaagaaatacttattggctgggcgtggtggctcacgcctgtaatcccagcactctgggaggcagaggtgggtggatcacaaggtcaggagattgagaccatcctggctaacacggtgagaccccatctctactaaaaatacaaaaaattagccaggtgtggtggcgggcgcctgtagtcccagctacttgggaggctgaggcaggagaatgtggtgaacctgggaggtggagcttgcagtgagctgagatcgcaccactgcactccagcctgggtgacagagcgagactccatctc

SEQ ID NO: 88225 - DNA, 2353 bp, Homo sapiens
ttaattgaagaaacactgagctgaactacaagtctatttcttatggtgctggattactcctacagaactgccctgagatcaaccgtgagagagggctctgacagacacaagtcaccttcttattgcacttagctctccctggggacttaaattttggcagtgttcctctttacatgatatcctccaagatgatgagttctaatcctgaggaagaccctttggacacatttctccagtacattgaggatatggggatgaaggcctacgatggcttggttattcagaatgcgtcagatattgctcgagagaatgatcgcttgagaaatgaaactaacctagcctatttgaaagagaagaatgaaaaacgccgaagacaagaagaagcaataaagcgcataggtggagaagtagggcgaggccacgaaggaagttacgtgggcaaacatttccgcatgggattcatgacaatgcctgctcctcaggacagacttccccatccttgctccagtggcttttctgtgagatcacagtccctgcactcggttgggggcacagacgatgacagcagctgtggctcacggagacaaccaccacccaaacccaagagggaccccagcaccaagctgagcacctcatcagagacagtcagcagcactgcagccagtaagagcgggaaaacccctgagaggactgaagcgtcagctaaaccaagaccccacagcgatgaatattccaagaagattcctcctcccaaaccgaagcgaaatccgaacactcagctgagcacatctttcgatgaaacgtacatcaaaaagcatgggccccggaggacgtcgctgccgcgggactcctccttgtcccagatgggcagccccgcgggagaccccgaggaagaggagcccgtgtacatcgagatggtggggaacattctcagagacttcaggaaggaggacgatgaccagagcgaggccgtctacgaggaaatgaagtaccctatctttgacgacttgggccaagacgccaaatgtgacttcgaccatcacagctgttcttcgcagtgtgctactcccacggtgcctgacttggacttcgccaaggcctcagtgccatgcccccccaaggggctgctttgcgacatccctccgcccttccccaacctgctttctcacagacccccgctgctggtatttccccccgcccccgtgcattgctcccccaactccgacgagtccccgcttacccctctggaggtcacgaagcttcccgtgctggaaaacgtgtcttacatgaaacagccagccggggcgtcgccctccacgctgccgtcccacgtccccggccatgcgaaactggagaaagagcaggccgcggccctgggacctgcctctgccacccctgcgctctcctcgtcgcccccacccccgtctacgctgtaccgaacccagtctccccatggctaccctaaaagtcactccacctctccctcccccgtcagcatggggaggtccctgactcccctgagcctcaaaaggcctcccccttacgacgctgtgcattcgggcagcctctcaaggagctctccttcagtgcctcactcgacccccagacccgtgtcgcaagatggggccaagatggtcaacgccgcggtgaacacctacggggcagccccgggtggctcccggtcccggacacccacgagcccgctggaggagctgaccagcctcttctcctccggccgcagcctgctgcgcaagtcgtccagtggccggcgctccaaagagcctgcagagaaatcaacagaggaactgaaagtccgaagccacagcacggagccattaccaaagttggacaacaaggaaagaggccaccatggggcgtcttcctccagagagcctgtcaaagctcaggaatgggatggaacaccagggccacctgtggtcaccagtcgactaggaagatgctctgtgagccccaccttgttagcgggaaaccacagttcagagcctaaagtaagctgcaaattaggccggtctgcgtcgacgtcaggtgtgcctcctccatcagtcactcccctcaggcaaagcagtgacctgcaacagagccagagcttcactcttgttgcctaggctggcgtgcaatgatgcgatctcagcttattgcaacctccacctccaagttcaactgattctcctgcctcagactcctgtgtagcagagattacaggcgtctgccaccacaccaggctaaattttttgtatttttagtagagacggggtttcaccatgttggccaggctggtctcaaacttctgacctcgtgatccacctgcctcagcctcccaaagtgctgggat

SEQ ID NO: 88226 - DNA, 416 bp, Homo sapiens
aactgtccaggacacagtgttacatccattctccatagggttttcttaagctgcgtggtttgcaatgtaaggacaagtgttatcctctcaaaagcgcctttggactggaattgattcctgtgtccttgagccatgtccttttcagccatttcacaattccttaactgttgaggacttaacatatatgagatatttgggcaggcacgacttccatgttcctgtctttcttcctaaaatatcagaggagcgggagtcacagcatctaaaatgaaactcatcttggcagtcccgtgaaatacggagctgatttgttttcttgctgcagagagcacaagaataaaggaagactccacaagcctcgtcttccagatcgtgctgacctgcttggctcagccttgccctggaggcagactcgg

SEQ ID NO: 88227 - DNA, 965 bp, Homo sapiens
tgtgtcctcacatgatggaaagcaggaacaccgtgtcctcacatggtggaaggggaaatactgtgtcctcacatgatggaaagtgggaacactgtgtcctcacatggtggaaggggcaatactgtgtcctcacatggtggaaggggcaatactctgtcattacatagtggaagcagggaacactatgtccttacataatggaaggagaaacaccatgtcctcatatggagaaagggggtaagactatgtcctcacatggtggaagggagcaacactgtgtcctcacatggtgaaaggcaggaacatcatgtccttatatggtggaagggggaaacacaatgtcttcacatgatccaaggcaggaacactgtgtcctcacatggtggaagtggggaacactgtattctcacatggtggaaggaggaacactgtgccctcacatggttgaagtgacagaagggcaaaaggggtgacactgtcctcaagccattttatgagtaccaatcccattcttgggacctaattacctcctaaaacccggctcttcttcatgcttttgcattggggattaagttccaacatgaaacatccaaaccatagcaacggtcttcagtgaccattgtcatgaggggaaaagataggagctttggaatcatccagtgttggatctaaggctttgctctgccaccaactagttttgaatactgttgacctataccaactatagtaggttcttataacaattaaaaggaatatcagagtaaaatgtgtatttataatgtaatgttttcaacagaagaaaatataaataaaaatttattgggtcctttgaatgcagaggaattttaagtttgatatcattggaagaaatcataaacaagaagagtaaaacatttagtattttaaaattaaaaatgtatttaaagaagaattaaaaagaataatatgtgcaaagtgcctgggac

SEQ ID NO: 88228 - DNA, 410 bp, Homo sapiens
tgagtgtcaggctagaatttgggagttaaggttttaggcaaaaaatagccggccaggtacggtagctcacgcctgtaatcctagcactttgggaggccaaagtgggaggattacttgagcccaggagttccagactagcctaggcaatatggtaagacccatatattagtccattttcacactactgataaagacatacctgagactgggtaatttatgcatgaaaaagggtttaatggacttacagttctacgtggctgggaggcctcacaatcatggcagaaggcaaggaagagcaaagtcacgccttaggatggcagcaggcaaagagagagcttgtgcaaggaaactcccccttataataactgtcagatctcatgagacttactcactgtctcaagaacagcaaa

SEQ ID NO: 88229 - DNA, 953 bp, Homo sapiens
accacacctccaataaaccatggctgccctaaagagaagaggccagtctgtctccccaggtcccctggtccccgctgcttgtcattgggcagggactcctggcttgaatccacaacacagctgccccacccagggctgattgtaccaactggtagtggctctgcatatctctgcagtggagccccaagaaacaagtgaaagtcctgctgccacaaccattgccaaggtcccatctcttgcttcctccaagctggggagggaacataaagcctgagcttaccccagggctgcagtgtggatcctgggcatgccaagctaagatctacagccagcattctggaggagctgacactttcagatcactaagagggagcacagatacaattgggaggaagtacagaggttccacatggctgagcaagagcctacctactggccattatgcttcagcaccatctactgagtcatagcccaaacttcatcaccaaaaacattttgctaatatacccacctgtgaaaccaaggacaaaaattagaattcagctacaaataaagaccctgcacaaaggtcttggccttctgaaaacatccagaaaagaagtcaactgacgatattcaaattataccacagttaaaggaatatcagcctacacaaatgagaaaggacctgacccgtagaagaactctggcaattcaaaaagccagagtttctcctttcctccaattgattgtgctggttccatagcaaaggttcttaaccagactgaaagtactgaaatgacagacatagaattcagatatggatagaaatgaaaagcatcaagattcaggagaaagtcaaaattttattctaatccaaggaatctaaggattgcagcaaaacaatacaggagctgaaagatgaaatggccattataaggaagaaccaaatggatctgatagaactgaaaaaa

SEQ ID NO: 88230 - DNA, 405 bp, Homo sapiens
cgaatctcctgcctcagcctcccaagtagatgtgattacaggcacgcaccaccacatgtggctaatttttgtatttttagtagagatggggttttgccatgttgggcaggctggtcttgaactcctaacctcagatgatcgatcggcccacctcggcctcccaaagtgctggaattacaggcgtgagccactgcgcccagcccaatttgtttttatctgttgaaatacacaagtctttcacaccatacctatgctacacaggaaggactcagataatgtaagaacagaagtctctatttaggttaggactcagttttcataaaaccaacagataataaatttacttttcaagatttctgtaatcactatttaatttaacttttacaaatccaaccaaaaccaaat

SEQ ID NO: 88231 - DNA, 399 bp, Homo sapiens
tgactctagcaggatctccgtcactggcatttgccttctttgaacgtggtttgagtagttggccccctttgattggccaaaactcagtgattggcacaagggtaggttacagtctgtttacacttccatttaggttatagttcactattttcagagaaacttaaaatatgtaaggaggcaactttagagtaaatttgatttaacatcatgtaggtcacaaccagaacttgcatctaatcccagctacaccatacactgaactttagacaagcaatttaacccctttcctttggtttactcaaaggcataaagggatagtaaataacattctaaccactgaattgtgagaactaattgctgaaaacatgaaatgcttgaaacagaaccaacatatattaa

SEQ ID NO: 88232 - DNA, 224 bp, Homo sapiens
ttgcacacacagctagtaaattgtttatgtactttttggtaattgtggtgatgacttaagtcatatgtgtcccaagtctctagaattttaggcaaatggagtttggggcacaaatgtacttctcagtcattgcttttcttttgctgcttggttacctgtttctgcaattgtcagtattcagtatcttcagagacagaggttttaggaaaataagtaaaaatatt

SEQ ID NO: 88233 - DNA, 377 bp, Homo sapiens
accatggctatggctttttcttgatgtttttgtgagtctatcgtgtttatagcttatgtcttttaggccctacttataagtagaaagagaacaggaagtgagctcccccaaaatagacatgcagtcaatatcacaaaccccaagagggcaagttctggaaccagcagattccagctctgcaatattagctctataacttcacccacattacttaacctcagtttcttcctctggaaaatggggaaaataatgacacccttctcatattatcacacatgaagttcctgacacagagtacacactgaatgcatgtgtgctgttattacaaaaaggaattaaatcagatggttttaccttccttagaaagaattaataca

SEQ ID NO: 88234 - DNA, 480 bp, Homo sapiens
ttactttatgttaaatacagaagtattccacattttatccacttacactaacaaacagctatcaaagtctttgttttcaaggataaccagtctactaatagacaacatacaggacaacaaatattaacataaaactgtttttcagtaaaaacaaaaaattgttcttttcagactttacagattaagaagcctgtggcaaacaatgtaatgaagaggccagtttcatatagaaactgtatgttaatccaatagagtttacttcaaataagttattttattgggttactaagattatacataggattcaagtctgtggctgttatctggagggaccgttatttgatttctgtgcttggctgagaaatactgtaagtatcttgatgaggctgccttttaaatagaggccagtgttaaaactagagcagctactgccacaggacacacgcatacttaaatacaatttaagagtgcagatcaatc

SEQ ID NO: 88235 - DNA, 748 bp, Homo sapiens
agatgtgcctgttatgataagtgtggagtgaaagaggacaactgcaacgatgtgaggcttcctaaggcctagattcagggctggtgcactggactgtctcttcagcttatctgccattggccaaagcaagtcacagggccaaagccaagttaaggggcagggagttgtactcctcccaagaaggtgatgaggaaattaataattttgaacagttatctgatacacactggattaataactactccaggatgcttgggtatcttatgagaaaagggttattattattatttccatcactgttgcaagtatttaatgagattttgtacccacaatggcaaaacccatgcaaaaccgcaagcgcaggaactgtgtatggttggctcgtgatgcatttaagatttattttctagcctcttacctaattcaaaaaggagaattctggtttctcatccatggatgagaaattagtgtcttggactgttttgcttacccgggctgactgagctgagtgattcttttattggctccggagctgttttcctaggagtggtaatagtgcttctctggccaaaggctaggactgcggaaaggatggctagcatcaggggtctactctgggcacagcaggagcgtgtcagtgtgagcttcaggaacagtgggacaagtgtcatgcatttacctgcttcagatgctgtccttcagtggagtgttcttacctactcagtctcattgcccaaatgcttgctac

SEQ ID NO: 88236 - DNA, 376 bp, Homo sapiens
caattaaatacaaattcaggagaaacaaattttgaggtcccattctagtttcccctgcacaaaaaaaaaaaaatacccgaccacaaacattagcagtcttaaatgtaaaccagattttcagttagacatatctaagtagatcattacataattttgactaaagtatttggttacatatggaatatagcaaagacggcagcaagctgataattttgtatatgtaactgattatctgagaaatttttattccaaaatagattacatatatactaaattcctactggtcattagcactttaccatagaacagaaaagagacaatagaagaaactcaaatttgacttaggtggtaatattaatttttatggcaatagttt

SEQ ID NO: 88237 - DNA, 354 bp, Homo sapiens
gtcatttccacccagcgacactcagaaatgttcaagaaaaccactcagtttttgcaatgttggattccagccccttgcagaatcagcaggtccacagtcttaggggctggggcagagagagccagaggcaggcgtttgagtccagagatggcttgcaactaccttagggcttgagccaagttttttttaaaaaaaatgtccaagcaacaaggcccacaaatgatacctgattataaatatataaagtgtctggcccatagctgctcaccaagtggtagttattattattttcctattggtctgtggtcaagatgtgtctgtaaatacctcaaacaagctcccaccttagcacct

SEQ ID NO: 88238 - DNA, 467 bp, Homo sapiens
ctctttaggcaaaaccagaaggtcagtgtctcttgatatcctcctcagctagcaaatgagaaaactgtcagagccatttggggagtggaaggtcacatcctccgaggggaaataaaataactgatttattctggcccacggattctatgtggtctgttaggggaaggaagaaagaggtgggatgaaaagagaataaagtagaaaaaaaaaggtggatggaaattttgaggggagcatttcccttgtgtcaggagtaacaaggataggatgattgggttaggagagaatctacatgaccatatctaattttcggtggatacatttaggtttttaattttcttttatttttgtttcttttgttagatcttcccctgacctgctcccagggctataacagatacggactttgaaactgtatggagtatagagcagtgctctataatttaaaatatacatatattgcaacc

SEQ ID NO: 88239 - DNA, 335 bp, Homo sapiens
ttaattagtttaaatctgtaagctaccttgaagataatggatgttggatatttaggcaaggacaggctgggtttgggacagtaatgtatctcccataatacaagagtgtgtaattaagtatgttaatggattttatgtccttctctgaagcatctgtcttggccagagtggaagacagaatattggacacactggacaattgatctctttaataggacagaacttatgctcctcttttatgcctcaaaagctaccatttcgccccatgcctgatgacataaactccaaagcctggtaatgcgcactcagggcatcctgccactgctaaatcattt

SEQ ID NO: 88240 - DNA, 431 bp, Homo sapiens
acagcatccacctaatcataaggagattctgtgggagggagctgagcaggtattgtaggaaaagatgtcaagggaacaattcagagtgcaggaacccacaagagtcacagcaccttgtgcctgtggggtgtgtaaggacaggggaggctgctcctgctgactgagtaaacgcctcaggatcatgagcatggtaaaaaaaaatggattaatatatttgttttttactttgaagcttatggattccttcccttccaagagaagaaaatcctctttctcatttatgtcaattataatttaacctttaggtgtgtggtcccaagcagcacattattggcaaaagacagctcagctcatcatttagaaccggacagctcttttagattttccgtcattcacattagctatgttgtgaacaaagtgatgcataaggc

SEQ ID NO: 88241 - DNA, 218 bp, Homo sapiens
tagatgctagatgctacccacaatgcaggcatgggatgccatcctctgccctcatgcccaaacctgcagcaaatacatttttcttatcaaatacaactcaagtcacttagaagtctataatcgtctggtgggaatcttagatttagcttgataacatacacaaatattaaataaaacctctccctataaacttgatatttgtgcaaaacaggtaaaca

SEQ ID NO: 88242 - DNA, 423 bp, Homo sapiens
actgaggggaaggagtaattatttaaattttttttttgtttaattaacatttattgtcttctgggtaacaggcactgttagggacttttacatctgctattttatttaattacaagagttcttcatttccagataagatttcccatgggcttcctttgactaatgagttatcttagcctggtgcttgtcagtcccagctgcacatgaaaatcacctggggagctttggagcaatatggtgctggggtgcttccccagagagtctgtttaattatgcagagtggggacccggctgcagtatttttaaactctggacaaaccagagatgtcatttcacttgcaggaaaaatacagcaataagcaactgctgcaaacttctgcagtagagcatgctatgccaagtagaataagcaaaacacctgtt

SEQ ID NO: 88243 - DNA, 209 bp, Homo sapiens
caggctggtggagcagctgcttctggaacatttcttgttgctacaactgaggaaaaagagaacagggtgaattatgcttgggttcttagagtttctgttcaggagtgatacacattacttctgctcaccttttattgacaaaagcatgtcgtaggcgatgcttaacttcttcagggggtgggaaagtaagcctcggacgggagcacgct

SEQ ID NO: 88244 - DNA, 318 bp, Homo sapiens
gcagtgagaatttcaagccagtggttcttggtttgctgggctttgtgggagtgggacctgctgagtgagaccacttggctccctaacttcattcaggcccctttccaggggagtggacggttctcctgtcccattggggttccaggtgccactgggatatgaaaaatctcctgcagctagctcagtgcctgcctaaacagccacccagttttgtgcttgaaactcagggttctggtggtgtaggctcacaaaggaatctattgatctgtggattgcgaagatctgtgggaaaagcatagtacccggggcgggtagcac

SEQ ID NO: 88245 - DNA, 337 bp, Homo sapiens
acactgatgcaatcgtagctcactgtggcctccaactctagggctcaagtgatgtctcacctcagctacttgagtagctagaactacaggcatgtgccaccatatctggctaagtctttaattttttttgtagagaaggggtcttgctatgttgcccaggcaggtcttgaactccttggctcaagcaatcctcttatctccacctcccaaagtgttaggattataggcatgagccaccatgcctggcctcaaattattttgttgtatttttttctgctacttgaaataactgagccatgacttggggatttcattatcattttttgttatatgggga

SEQ ID NO: 88246 - DNA, 413 bp, Homo sapiens
tttaaaaccattatcttagaggttaggattttaacatctgcgttttaggggaacacaaatattcaaaccatagtaccagatgttttattaaatgaggaaagtaactccctgcttcacagtcatattttctattacatacttaccacagcatccctaactgccttcttataacatagatcgtgggtgtccttgtaatcacttttagtttttttcaattccaaacaaaatatcataattcctaatcaaggtaacacaattatttcaacatgtgtacaataaatcctgtccataatttacaaaggcacaatatattatttgttctgaatatataatagcaaataaagtttcagcagtattgtataacagctaatattatatgagacactggcaggagagatcagcatgtgtgttgt

SEQ ID NO: 88247 - DNA, 597 bp, Homo sapiens
cttgtttttttaaagcaaaatttcattgctgcccatttgaataaacttaagcttaagaatattaatttctttacattatgtgcccttctgtgataatacaccattttcacaaatgcctctgtgtatctgtgtcagaatgttatgatagaatttgaaatgaattatttcaaaattaagctcttatgtatggttatacacgggacatgcatatttgatgtttaataggaagatttaggataaacatgtaactattattattgtggtcaaattatttttatttaataagacttttttcattccctaaacttttaaaaactactggctcttgtaccccaatcctggaaattcttccaatctgcaccgggatactggaaactgcctttaaaaaatttccacaaagtgattcttacttaggtagcttgagccaaactagcgtttggatttaagccgtagattaagggttagaggtgttcagatgagagaaggatgaatgtaggatagagtggtaaggaaaggctttgtgatattagatagattttagataaaggaagagaaggctgtagaggaggtatgatgaggaaagtcagttcagaagaa

SEQ ID NO: 88248 - DNA, 277 bp, Homo sapiens
atttttttttcatttttgaagttttcaagcaccctccctatattttgtgcctgagatgatgatccactatctgccatgttgctatagcagatggataatttaactcagtagtaggaggttctataggttatcaccctatgaaactcatatcttttgtattaaaacctcaattctttattttcgaagggtgactaggagaaacttggcatactaccataaatcagagagaagttgaactatagcaatttaattggatacatattcattgacttcaaac

SEQ ID NO: 88249 - DNA, 398 bp, Homo sapiens
cctccttttactccatccatgcctcatactctccactgaccagtcttaatacacagcatctgatcccagcctttggggttggggcccctgcctctagtattgtccaggacttaggtttagttgggagagcatcacctcttaaatgtataccattggctcatgtcatctccatcagtttttgggtggagccccggtgtttggccattgtaacgaggggccctcctgcctcccaaaattatgtgtgtattattcttatattcccttttctggagacaagttcttgatcatgcctaaccaaaaggtgggttttgaggaagcagtacagcaaagacagttggaaaattgaaggaaagtacagcctgggactgctgcctggtcgtgtgacattggtcgacttc

SEQ ID NO: 88250 - DNA, 84 bp, Homo sapiens
actgatatgtaaaaccaattttattaatttttcagtggggatatgtctgtctccctcgacaggagccctcccatcaggcagatc

SEQ ID NO: 88251 - DNA, 190 bp, Homo sapiens
aaattcttttctcctcagtatacatggaatagtgttttttttgttttgttttgttttgtttttcagtcaaggctggtaccacccttacctggggatttaaaaaacaaaatatgtgggagcattttatggaggaatcgttggcccagaatactaatagcatctcattgagaaacaatgatatgtgtactga

SEQ ID NO: 88252 - DNA, 1009 bp, Homo sapiens
aacggtcaataatgaaggtggctgcggcgcggcggcaggctcagctgcgccgggcgggggcggcgctggggccgcgcctgtaggactcggggccgacgccgcgggatggggacgcggcgcggggagtgaggcagtggcggcggcggcggtaagcggaacttcggcccgaggggctcgcccgctcccgcctctgtcttgtcggcctccacctgcagccccgcggcccccgcgccccgcgggacccggacggcgacgacgggggaatgtggcgctggatccggcagcagctgggttttgacccaccacatcagagtgacacaagaaccatctacgtagccaacaggtttcctcagaatggcctttacacacctcagaaatttatagataacaggatcatttcatctaagtacactgtgtggaattttgttccaaaaaatttatttgaacagttcagaagagtggcaaacttttattttcttattatatttttggttcagcttatgattgatacacctaccagtccagttaccagtggacttccattattctttgtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaagacacatgtggcagttccagaaacagcattattacaaacagttgccaatttggacactctagtagctgtaatagaatgccagcaaccagaagcagacttatacagattcatgggacgaatgatcataacccaacaaatggaagaaattgtaagacctctggggccggagagtctcctgcttcgtggagccagatt

SEQ ID NO: 88253 - DNA, 372 bp, Homo sapiens
tgccaatttggacactctagtagctgtaatagaatgccagcaaccagaagcagacttatacaggtatggtgtgatattcagtatacttattttaagtcctatttacagacctcatttttaaataaccataaacataaaatgaaatctttagctaattggagactgtatttgtggggtgggttggtgggagatgcaattaatggtgaaaaaaactaagagcagaaattgctagaattctaagcaaaagataatagttcaaagccagagtttatattcacaagtttcttcacattaccttctattttgctatgaactagcatgctcactttgtagctataacagtagttatagtagacataagattattttctt

SEQ ID NO: 88254 - DNA, 491 bp, Homo sapiens
gcagcagctgggttttgaccccaccacatcagagtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaagacacatgtggcagttccagaaacagcattattacaaacagttgccaatttggacactctagtagctgtaatagaatgccagcaaccagaagcagacttatacagattcatgggacgaatgatcataacccaacaaatggaagaaattgtaagacctctggggccggagagtctcctgcttcgtggagccagatt

SEQ ID NO: 88255 - DNA, 718 bp, Homo sapiens
taccacttatctaagccaagtaaggttaaaaatcagtgtgttcacaaaatccttcaatgataccatcataggaacagtttgctatctttgtgacaaataatgaagacctatctagaataccaacttattggtactaaagaaatcagtcaatatttacatgtatgcatagtatattaattcagattgtaatatatgtgtagcctgctagtagcttttcaatggaaaaagtgaaaagagcttcatgttaacttttttaattttaataggttgcttcttcaagtggaagaagtatttgactgggggtcagaagacctgggttggaatcctagttccatctttctgtaataatgtaggtctgctctgcccatcctctgccctcctccctcagaaaaatctctgcaaacccatgatgtccaacagacatagctcatattggtcacagctaacggagttaactacctaaccaagttgggcctatctaactggctaagaaaaccaataacttctgggacttggtcaaaatgatgcattgtcttgcaagagtttttaattgagagacatgaggaagttgctagtgggttgtgtatgctacagctgaaatatcccatagggcagcaagattaatgtacagaagaagccagtcatggctaggcatggtggctcacacctgtaatcccagcactttgggagggtgaggtgggagaaccctgtctcaaaa

SEQ ID NO: 88256 - DNA, 146 bp, Homo sapiens
tattatgacacaaaaagtgaattacatacattctttcacttcagaataaactggagtaatagtaaacagatttacttcacaccttataatctagaaaactagaaaattacatgaaaacagttttcataaacattgtaaaataggac

SEQ ID NO: 88257 - DNA, 462 bp, Homo sapiens
agccaacatttgatcatttctcttttaatgcattaatgtgatgactctgtgttactaggatttctaatgttaagtaatgcctccttggatatatcttttagtttatgaattaaactaaattaaaatgttaagggtttgtttaataacttgtatatttaataacaattgttattactgtttgataacaaatattaaaggttagttgaatagtaacaaaggttattatgaaatatttcaaaagtaaaaaatgttaaaaagcaaaaggcccactaaacaccttgagaaaaaaaaaaataaaagctttagtaagaagttgagccaggccctgtagctcacatctatagtcccatcactttgggaggcggaggtggcagaattgcgtgggctagggaggccagcttgcagtgagtcatcattatgccactgcactctagcctgggtgacagggtaagaccttgtctc

SEQ ID NO: 88258 - DNA, 571 bp, Homo sapiens
acacgtcgaccctgtaggtagtgcactgtcttgtgtactggccagcggtgtcacagtgtccgggacagcatgtgctccgctggtggatgacactggctgagcatagcaagaaaaagttaatggagttgcacgaacaaacactgaactaaaacgtcttcatttaaatacagaatctgcctctgtcaagaccagtactcctctctcagatttctaagagtaactgcttactaaaatgccactgtattcctgcttgacccaaaattaatccaaaatatactccagggcaatcagaaaacttcatgtactctacctggaaaccttattctagcttctacctgctggaaagagtatttttggagagatggaatatgtcctatgctgaagacctgcatacctgccacccagcaattccactcctaggtccacccaacagaaatgcatccagatgtttggcagaatatgctttagaatgtctctcttcccatctccacccatgctctagaatgtccaaagccatactgttcataatagcccaaactggcgaccacctgcatgcccatcaacagtgaat

SEQ ID NO: 88259 - DNA, 1471 bp, Homo sapiens
gttataaaatatagacacaaatcttcttggaaggccggaaggttttgcaaaagtctcaggatagggttatggctgaaagccgcctaatccttactttgagtaaatagcttaaagtagatacaaaggaatgtagagtagtttatctgaatagcttgtttactcatgtggtcttaagaccaatctttgatcaaccgggtgcacaaccgcagggggtgggggcggggttgttggcaaccaggtcaattaccctctagcagtgtttactcaaaacctttgtcatttaatctatactgaataaatgcaagcttcgctggctgatggggccggctgctactctttacagcaccttccttggtgtctgtgaggggcccagacccttagctggagtgacaggcagaatatctgtgttagtgtacgttattcaaccgttgttgggtcaaggtctgtgggacagaccccggcaagcagggactgataaactacttactgttaggtactatgctcactacctaggttcaatcataccccaaacctcagcatcacacaatatacctttatcacaaatctgcacatgtatcctcgattctaaaatagaagttgaaaaataaaataaaattatagtctttccaaccccacttccctatccctttacctagttttattctttttcttttcccactggacatattgtctaataacatactatataatttatttatgtgttgattgtctacgtttcctcactatagtgtgagcaccacaaagggaggaaattttggggagtctattttatctactgatcattgcagtgcctagaagagtccctccacataataggtgctgataaatatttgttgaatgaataaatgagtagcatcagacatctaatactcaccttaaagtagggctgcacctaagtcatccaagacaaaaagggattttgtcatcttgttctaaaactctccaggacccggactgcacaaacatcctttgttaagccaattcctgattaccatcacaccctctccttaaatgtaatcttcagtttatttctggtaatatttaaataaagtaaatatgccaatgaccaatgactgaagaaaactatttctgtatatcctcaccaatttatccaaggttaccatgaccatattgctttcattcctttcttcttctcctacatgtggatctgtcttcattggccatcctttcactctctccaatcccccaatctgcagtctcattcactctatcaatgtgattcccaaatctatatcattgattctgcatctattcttccagcttccatcgtgtattttctaggcctactcagatgattccattagaatgccttattggtacctaaaagtgaacaggttgcaatttaaatgcctcaccttccccttgagactggcttctcctgacttcctacttccattgggcaatcaaatcctggaattctctttgactc

SEQ ID NO: 88260 - DNA, 180 bp, Homo sapiens
attttggagcagttcaaatctaacaagcatttaccaaaggatttaatccatatcattctttcaaaaagtctggcctataatcccaatgctttgggaagccacggtgagaagaccacttgatcccaggagttcaagaccagcctaggaaacacagaccaatctctaccaaaaatgtttaaa

SEQ ID NO: 88261 - DNA, 493 bp, Homo sapiens
gtagtgggaaatcagtaggaagctggtaggactgaaatatggttagaaaacactgctctcctgaaacacaagatgctttagaatacctgaggagaggaagaagggcaacgtaatagtaaaggaaactaaaaggcaaataattagttctatagtttaattaattaatccgttcattaaacatgaggggaggttattctgcagggtcataatgaaattagcagcaacaataagctccagaagacaacaccctttaaaaaaaaaatgagttctctgtacttccaagaaagccctaagtctatattagagttttcttagtctgaatcaggcaagtgaagaaattgcttctctttgtctcttgttgctaatcacagaggaaggagtgatggggcttatctccaaagccatttcccaagaacacttttccgctcctcacatcagcattatccctttctgttgaatgtttcacacttcaagtgctcgatgatgaatgagc

SEQ ID NO: 88262 - DNA, 448 bp, Homo sapiens
tgtagatactgatagcctgtatttgttgagttctaattatgtgttcaattatcaacatcacaatgagatagttaccattttctagaaaagaaaatccaaacttagagtaagaaagtgatttacctacatttccatatgtagtgatattggagccatgactctgactcatttgtaatttaaaacctcatgttcttaaccacagtgctgtggttatcatatatattaatcagtgtaagtaaatgtaaatgctttaacagagaaactttgaatttcatcagattgacaaaataaagtttacattgtttactcatgttatgatccaagattcaatgcagttgaaatgttgaaatgttgtctatcagtaatggaatctgaggaacagacttaatcggagtgcccaaagacaaaaatgtaatagatttgatataaataaaacattttatctgcc

SEQ ID NO: 88263 - DNA, 346 bp, Homo sapiens
ctcaggtgatccatccacctcggccagtcaaagtgctgggattacaggcatgagccactgcacccagccgatactactatatccccattttacagatgagcacatgggcaaattgagggtaaggcactgacccatgatcatacagctgagaagtggcaaaggcaggatttgaacctagaacctctggctccacacactagtaatctaaaccactctccctacaatacaacatacgtggtaaagatgtgtggtgggcacgcaatcaacgtaggtcccttcacagttgctgggagaggcaggaatttgcagttcctccgcgttctcctcctccgctgcccacctgtcc

SEQ ID NO: 88264 - DNA, 402 bp, Homo sapiens
acaagtccaaagaaggcaactgcatcactgtaaacaatctagtatttaatatggtttggctcctcatgcaacatattgtaaaccaaaaatattggagatgcttctggatcaacttagaagtttattttcccaaggttaagaatagacccagaagaaatcaacacggaatcacagcaacagtctgtgactttctccaaggacaattttgaggacttcaatatataaaggggaaaagtgtgctggataggtaagagggagggttagtatgtaatccacatactgcaacaggaaagaagcaggcaagagaatagtcagttaggtatttgtgtctcacccagtaaatcaacactttacttgagatacacagtttcctgtggagatatataactttttttttttttt

SEQ ID NO: 88265 - DNA, 426 bp, Homo sapiens
aaatagagtggaaagttacagagagttcccatatcccccatccctctcccctctttcaagttcagagcttcctcaaaatgccatccaacagcttcttcttacacctcattggtcagaacataggcaggctgggctaaaggagaccggggaagagtagttttttagctgcacactttgctgttttatataatggcgttcctgaccaaggtaggcaaggaagattgttgagtaggaaacctaaaatctctgtttacagccatataagataatctcttattttctcttccttaagcaagagaaagttgaagtccataccataaactggtatttttagaaagctgtttttttggaggttgtttttgctgttgaaatatatctactctgtttaattattattagttcttaagggcttcatctttagcaggg

SEQ ID NO: 88266 - DNA, 1005 bp, Homo sapiens
tatccagtggacccagaaccatcaattcactaaatttttcttgaacctatgtatttagaatctcccggctgggtgcaatagctcacgcctgtaatcctggcacttcgggaggctgaggagggtagatcacttgcgctcaggagttcaagacccgcccacctcgacctcccaaagtgccaggattacaggcttgagccaccgtgcccagccagaaggaattgatggtggccgaagtcaggagccgggtgcctctttggggtggatcttgaccgggaaaagggacttgagagaaccttctaggataattttatttcttgattaggtggtggttacatttgtaaaaatcatcgacctctaaatttagggtttgtgcccttcacataccttgttgtatgcattttgccacttgttttttcaaagcaatgaaaaagtatcactgcaattaggttttaaataaatttgtttcgttaacatgtctggaagtcttagatgtcttactgtggaaggtctcgctgctgtggagcccacctctttcaggccctctaaagtatagagaagaagcagagtgctcggccccctttggggtgttacctggggtttgggtgggagctaagagacacacacagtaagtagtaacgatacgaggcaggcggctctgcaaggcggcactgcagaaagggttgtgtatgccacatcatatgccaaattcacatgcatgtctttttttccccataaaaactgaaattttaaaatgatctgtgataggaaatacagggagctgtgattctcctgggaaataaaggcacttagagcatggagccggtgagaactcgcagcggagaccagagcaggcccgggggaggctttgcactatgggaggtgtgagttccagagggaggggtggccgagctcaccttcaggtttctgttattcagtgaaagcctgcccttgttccttggcgttggtgtgtgcaggacctgcctgctctctcccacctccttcagg

SEQ ID NO: 88267 - DNA, 571 bp, Homo sapiens
atttagacacagcacagaagcctccctcatggctgtgtggtgagggaaaggattgtccaggtgacttctagggttttgggtggagcagttggatgaatggcagagctacgtactgacatggagaaagggctggtaggagagggaagagcagggagaaacccagctcaagtaggtggttcgcctgcccaggaatcactgctcatcattaagtagatttgccgctactgccctcacgaggggcattgatgacgagttgcccctgttagtagtaagtagtcgcccatgctgttcaacaccagccacacagagcacctgccctgtgtctaacgtcagaagctgcagtctgctgatcctgtccagcgtcttgctacattgacctgaatctcctggtgggctctggttgaatcccagtttctgctgctctggagaacatttccttagattcccgagatgcccccaagttccccaccaagtgagtgccttgtaagccctccaaccccaaagtcataccgtcccagtgtccccttcaaatctgataaaaatccagccagccatttctaccaaatgagat

SEQ ID NO: 88268 - DNA, 470 bp, Homo sapiens
tgtaaacatatatgtagtgtatattggtacagtattttcattaaggtgtgtttcattgcctcagttaaataattaagggtgttggctgctgggatgttgaagtatttgcttacataatccattgctgtttgggtgagactcttaaatggatttagacagataatggtgagaaaactggattttttatttagaacgtggctgaacaaggcaatgtggaaatagtgtgataacaaggtgcattatataacttgaacaaatcaactgcaaaaagacattttcaaagaaatggaggaaaattgaataatatttactgaacttgacgtattaaggaattgttttaaattatgttggatgtgataatggtattgtgatttttttttttagtgctttagagcaatatactgaagtttttacaagtgaaataatgaatgagggccttaaaatatgccagcaaaaaaaaaaaaaagtga

SEQ ID NO: 88269 - DNA, 371 bp, Homo sapiens
tgattatgagcctgggctttaactcgtgatagaagtttttcaagtactggctctaccacttatgagctgtgtgaacttggacaagttaattgacctagcaaagcctccctttccttatttgtggatgagaatgatggatggtacttaactcacagggcctgtgtgcagatgagatgagacctagaattaatagcacactttcaggtgctattccaaatgctttacatgcattcatgcattgaatttttgaaacggtaaccatataaggtagtgccatcattatccccatttaacagatgaagaagctgagggccagagaggttaagtaagtttcctaaagtcacatgactagtttcagagctgggatttga

SEQ ID NO: 88270 - DNA, 317 bp, Homo sapiens
tttttgtctccccctcctttatctctcaaataaatacttatacttgaatccatactctaggattaggcagattggcccaaatctggggaacccacattgagatggaccctataatttctcttttttaaaaaaacaatcaggctgggcgcagtggctcacacctgtaatcccagaactctgggaggtcgaggcaggcagattgcttgaggtcaagagtttaagaccagcctggccaacatggcaaaaccccatctctactaaaaatacaaaaattagcctggtgtggtggcgtatgcatgcctgtagtcccagctact

SEQ ID NO: 88271 - DNA, 787 bp, Homo sapiens
taaatatatattagtctaaagataaatcttagttgtaagaaaactatggaatatgagtttgtccctactttcagaaaaaaaaagagcaatataggaacaaaacaagtcattttaacaaggtgactactagaaaactaaaaacctcaaaaatgcaaaagcaaacatatactctctgctttgtattgaatttattactgtataatctatgccttatacttcggaatctccccatgcaaattctgtttatacttgcctggtactcatgatagacccctactttttggtattttgtatatttattttatagtttatgaaatattcattatgtgagctggaatgtgagtataagaataatttttatgaaatgtgcatacaaaataattttatatgtaattccacaattagtatattaagttacattttatttagctagaacactccattttgttttcaattggagaaccctatataagcttactattctttagttattgttctttttactttttataattgacaaagtaaatttatttatggagtcaaattgttcaggtaaatacaagggaagcttagtaagtcatgaagatgtttttacatgtaaatgtggaaagcatatatagcagttcttggtgtgtaacatgctccagaaaaagccataaacatttctgctaaagttagtttgtaacttcaagtcagagatagaaaatattagtagtgaagaaatacagctgatgttttatgtggagaggacacttttccaggctgcaaagctgagtgttgctgaatt

SEQ ID NO: 88272 - DNA, 388 bp, Homo sapiens
tttcaggtatgtgaacacttcctttttggtgttttcaatgctggtacactctatttagatatatttatagtcatttcagtggtaactagatgtggggttagagggagtcagatgcttgtaccacactgctatctgtacctgtgaggaacaggttttgctattagtaacagacaccagaaataaaccatcttatgttccagcttgggttttcactcatataaaatatatctagaaataggcagtctggagcatatatgcagctatgtgctcatcaaggacctaggtgctttctatctttctacatcaccttatgccctaagaaagctactgaagcctcagccatcatgtctgtgttgtatcccagaaagaaaaagaaaggcagaagggc

SEQ ID NO: 88273 - DNA, 971 bp, Homo sapiens
caagcgattctcctgcctcagcctcccgagtagttgagatttacaggtgcccaccaccatgccaggctaatttttgtatttttagtagagacggggtttcaccatgttggccaggctggtctcgaactcctgaccccaaatgatccacccacctcggcctcccaaagtgctgggattacaggtgtgagccaccgcacccagccatgttgatctatttttaaaaagtttttatttcctgttacactgtgttcagctatcttcagccaccttaaattcccatggatgagttttcataaactttttgaaaatagatttagatttacgggaaagttgcaaagataatacagaatttaatggatgagtttttttattgatgtgtaatagatgtatgtattttcagagtacaagtgataatttaatacatgtatataatgtgtaaatattaaatcaagagttattgggatgtccttcaccttaatatttatcttgtctttatgctaggaacattatttgaattattctcttttacctattttgaaatgtacaatagattaacattagctatagttactctactgatctatcataggtcttatttcttctgtatttgtgtccactaatcaaactcttcatcctcacgtccccaccacctttcctggcctctggtaaccaccaatctacctccatctccatgagatccacttttttagctcccacatgtgagtgagaacatgtaatatttgtcttttctgtgcttggcttagttcagttaacacaatcacctccagtttcatccatgttgctgagaatgacagaatttcattccttttatggctgaacaatattccattgtgtatatataccacattttctttacccattcatccattgatggacacttaggttgattccatattttagctattgtgaatagtgctgcaataaacatgagagtgcatatatctctttga

SEQ ID NO: 88274 - DNA, 177 bp, Homo sapiens
cctctggtacctaccactggtccccactttcccccttgaattgagctttctccctaggagctgtctcagctcccaaggcccgcttctccattacagacatatttagagcacagtgattagacctagggaggtacaacctgctgcttactgtgcttctgctaaggaggcacctcagat

SEQ ID NO: 88275 - DNA, 793 bp, Homo sapiens
caaatgcacatgaaaagatgctcatcattagccctcagggaaatacaaatcaaaactgcaatgagatacaacttcacacccactagaaaaactaaaatttaaaaaatgataaatgctggtgagaatgtggacaaatcagaactctcatgcactattcatgggattgtatcatggtgcggccatgttgaaaaagtttggcagctcttcaaaaaaatgttaaacatagaattatcatatgaaccagcagttctacacttaggtatatactcaagagaaatgataacgtgtgtgcatacaagcacttgcacgtgcatattcatagcagcattattcataatagacggcagaaacagccccaatatccgtcatttgatgcatggataaacaaagtgtgctatatccatacaatgaaaggttatttgacccttaaaaggaatgaagtacagatagatgctacaatatagataaacttgaaaaattatgctaagtgaaagtggccagacacaaaaggcacattaattacgcgattctatttacataaaatgttcagagtaggcaaaattctaaatatagacagtagattggtcatttccagggttggttttttgttttgggttttgtttttttttgtattgatggaaataaatgctctggaattattgacgatgttcagaaaaacctcatgaatatattaaaaaccactggcatatgttttttatatgttttaaaaggatgagttttatggcaatgtgaactatatttcaataaaacttatttttaaaagttcaatggt

SEQ ID NO: 88276 - DNA, 289 bp, Homo sapiens
cctgacccacagatttgtggggagggatttccccacacaatgaagacgtcctcgcaaccagcgaggaggcggctaccgtggaacttgtccctctcacctgccagcgatgtcctggggccacatgtgattttcaacactgggggcagagagcactctggtggccaaggggctccgcctcaccctgggtatcctccgcctgcctgggctgggcctcctctgtgagccagagaaggtggacccctgaccaagccgaaacacatttcctttcaactcactgaaatatcttttc

SEQ ID NO: 88277 - DNA, 289 bp, Homo sapiens
gggtaggacccgactacagagtagacacctcagatccatagccctacggtcagagccaatgtatgggatggcggatcgtcaggtgttgtaattactgtggcccctcattgacataaatattatactagcatttaccatctcacttcgtaggaatactagtatatcgctcacacctcatatcctccctactatgcctagcaaggaataatactatcgctattcttatattcagctgctctccagtgccccagaccagccccccaattccttctacatggtccgtatcatt

SEQ ID NO: 88278 - DNA, 412 bp, Homo sapiens
tgccaaggaaggggtgggtacagagaaagttgggaaattctagccgagtgttgggccaacctaagcctggagcagtttccaggaaaaatgaaatcattctggagaagaggcaggaatgtgacttccaacatcctctccaagaaggctcccaagggtaaaggtgtgagggagaattggagagatagaaatcaagagacttcctcccggagggcagaggcaggtgctgcctcacagatgtggaaaaagaattctgtaattttagagtcgtggaatatcagaattttagctcccaagctctaaaacccaaaattatcagaggtctgctgtccaatcttttcccagtgcctgagtcccctctgcagcctccctgataggggccatccagtcccttgctcaccctctcatcccctct

SEQ ID NO: 88279 - DNA, 396 bp, Homo sapiens
gtttttcaggctgaaagcttatacattattagataaaatgtgctttgattctatttaacgggaacaaaaaagggcacttaaacgagaggtttaatcagtactattggatatttatctttcattcttttacagtcatacatttgtttgtttttgagacaggaatctcgttctgttgcccaggctggagtacagtggcgctatcatagctcactgtagcctcaaactcctgggctcaagcgatcctctgcctcagcctcctgagtaactgggagtacagttgtgcccagcatgcctacctaaattttttaacttttgatagacacagggtctcgccacgttgatcaggctggtctcagcctcctgatttcaaatgatcatcccacctcagcctcccaa

SEQ ID NO: 88280 - DNA, 394 bp, Homo sapiens
taattgccctgagtcaactaattgacaaaggaaaatgctatgcttaaaagctcagttctcagtgtaattatttttctctccccacatataatcatcctttaaatataaaagctattatagagatgcagtttccagcaaactttatctcacattgaggcccttgactttatgtggtgtttcagatcagcttttttgtcaagggtcacacattcattccagcatcacttaattctttagctgttagtctccatccagcactagggtagaccctggagatgcaaaagcaagctagagacagtacccttattctcatggagctaaacattagagaggtattggtgtattcttcggagtatataatgccctttccagctatggactctgcctttcttta

SEQ ID NO: 88281 - DNA, 561 bp, Homo sapiens
cacgagcagaaatgtaacagatctttgaactgccttaatatgttgcctccctatcttgaactcctcttaggagtttagccttttaaactaattgttacgtgctttattatttatgaaggagctttgcactgaaatatgccaaataggaataattactacagatagaaggagtcgagaatgttagttgataatcaagcagacaaatcaccggttgtcctgttctgccaaatcctatgttgcctgtaattagctgtgggggcaggaggtgtatgttacacatcatgaatcctcaagcctacttttgcttttacatctcaagaccaaagccatccttgcattccaatatctgtccactttttttcctaaccaatcatcctaataatgtttggataaatcgtattagcagtcattcccttttcgagtctaccctcatctccatggcatcctgttcatagtcttaaattccagggcaagggaacaaaagagaacaaaggaatcgacaaggaatgatatgtaggttaattatgtacagataaaacatattttaactctctccacagc

SEQ ID NO: 88282 - DNA, 468 bp, Homo sapiens
tgctatgatgttgaagtagcataaaacatatattagatatctgcaacaactgtgatgtaacatgaaaatacctgatttctgttgacaaagttactgctagtacaactgtggattgttgtctgcactcgtcattgaaggaaatactaaattttagttttaggctagtgaaattaaagttaatttttcccatccaagttcatgtatcttctgaattctatccgtgaatcccttagaggtctgtgaattgtaggttaagaacccctgccctagctaatcagatccaccaatgtttcaaataggactataacttattcaaaggccaatgatacttcgcataattcaattttaatattattcacatttcatgtcacaaatttagtaagttacatgtgttatgtgatgttttgttttgatagattatatcttactcctaaataaaaagtcaagatttttgtagcaacttctatt

SEQ ID NO: 88283 - DNA, 613 bp, Homo sapiens
tcaagcctctcctcccaacttgtatgcagccaacttggcgtgttctcacaatggcctttctgctgtgtctgcagagagggagagatctctggtgtatcttcctccttttgcaaagacaccagtcctctgggattagggccccacccttatcacctcagttaaccttaatcacctctttaaaggttctgtctccaaatgaaatcacattggaggtcagggcttcaacatgtgaatgctggggggacacaattcagtctcacatatgcagtggaaagaagttgacacactgagcagagcttttgcatctcctagtgttggggagacaataattggtgacagcccacaagatagggagactctgatgagtgacccagaccttcagctgagagcactgagggctgcaataggggaggaaggctgaggggtgagtagatcgtccctctcaaagtctgaaaccaagcttccaaagggctgactcccagactaagttgatctgctctctttcccacagccagcccaaagcaaaaggaaatatgcagaggtaaatagcatcatccagggcctcaaattaactaaaatatttccatatacaatatccagatttaaagtttac

SEQ ID NO: 88284 - DNA, 422 bp, Homo sapiens
taatcatctttgtgaatctaacatttatatattgttgaattattttccatggataaaaatccaaatgaggcttttaatttaaatgttatcctattagtattacttggattactaaattaatatttaaacagattaaacaataatagtagtaaagaagtgtctgtcttcagccttgaatacatttcttaattctcagaaataaccatccccattaggttttcttatatcctttcagaagtagtattctgtgcttttttgtgtgtgtgtatgcatatattttgataaaactatcttcttcattattttcaatgtctgcatagtaaatatgaattttttgatattactcttatccagtgggaatgattagagatggagtctcgccctgttgcccaggctggagtgtagtggtgcgatttcagctc

SEQ ID NO: 88285 - DNA, 188 bp, Homo sapiens
actaagcatttataaacttttaaaacttatgaacatcgaaaggtcgtgttttgaagatagttttttaataaacataggatttaaatcacttaaatatctaaactcaataaaatctatacttcaggtccagtaaaaatccacctagataacaaatttcctaaaaatcttaatgtgttttctttggtaag

SEQ ID NO: 88286 - DNA, 212 bp, Homo sapiens
gtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagcattactcttc

SEQ ID NO: 88287 - DNA, 442 bp, Homo sapiens
tgatagacatttccaacttttttcttagatactcctattcttgcttcagttcacagcttccattaaaaacttaggtcccttcttatgtatacagatagaaatatatctacttatattcatgttataatgcaaacagacatttctagtttattttagaagttgacaacagacataagatcacaactatcttgtgaggtggaatgtgtgtcttgctcatgtttataatcttaggacaaattatagtgattgcactttgcagatgctcagcaagttcactcactgattaaccagaatttcacagtggcaatacactccaactatctaaagttgatatgggccaggcgcggtagctcacacctgtaatcccagcaatttgggaggccgaggtgggcggatcacttgaggtcaggagttcgagaccagcctggccaacatggtgaaa

SEQ ID NO: 88288 - DNA, 174 bp, Homo sapiens
atccaagatatctttgagagccaggaacctgctttgtgataatgatctccacttttacctttgagggaaaggaagtggccctctagtcacagatggatcatggcgagcagtggtcccgaaggttgacttctgcaagccatccacatcaggtttggaacctaccgagaagagtct

SEQ ID NO: 88289 - DNA, 270 bp, Homo sapiens
ggctccttctactgcaggccagacctggggctggagtgaaagagtaatgaattgatttaagcctacggccctggcatacttcttctgaagtcacaggggaattcacatcactctgtgtgacctctgtcctaccccttttatgtgagggtggtgaaaagcaagttgaaatgcaaagggtaggtagtctgggagactgacagaaaatgctgtgcacatgtggtttttataatgagatatacagcttgtacccgaagccaagaacatttcaca

SEQ ID NO: 88290 - DNA, 624 bp, Homo sapiens
tatttttgcccttaaaacctttgcaatacatttatacacacacactcagcttgcaaagccttctttagaaaataacccactctgagtagaagtaatgagatatggtagcagcatgggcaaagccataagaaacgttatttgcattaaaaatgagtttttcagtatggaaaatcaattaccaaatgaaatagagattttttttaaaggttcaaaccttttcaaatttttatgttatagggtttatattgattaaaataaatgtacgtttgtagttattcaacattatgaatttcaagatggccacctattttgaaacgcacacctttgccatgaagtctgttgttgcatatattagtgctgatgtaataaaatgcttctattaactatgtggttgttaataaatcttgtaaaaataaagttctgtttattttatggtgtcagaacaaaatagctgtttaaaatcacttattttagtcttagcttttaaatcaaaatgcctataagaatattaagttctaagattgttgagaatactaagataaaattaaaaattgtatgattttacaatttgctataatttaaaaatcttgtattgattaaatgttaaatcaggttaaatatttg

SEQ ID NO: 88291 - DNA, 1200 bp, Homo sapiens
gcagcacctctgtgaattagcataagatagaaagaacagaggtttggagtaagacagaccttatccttgagcaggagaaggacacaaggtctgtgacagaagaggttggccatatagcagggtacttttcctgccaccccatcatgcaccccctcccccattaaacagaacccagcaagcccagctcagagaggggcataaggagccaggcagactttttcactggtagcagaagcttgtcacattctactttaaatgtcatataaccatttttttttcaaatggatataaattcctaatttggctttttcctttacacattcctttggcatatgtactaagcacatgtttaaaaaaaaaaaaactagctgtagttcacttctgattttcttactttaaaatgatcgtcacttcatactcatgcatatttcattatgtaaaccgtaagatcctttttgaactcatgggaggaagggtaggcaagtgtaaagatacagttttgtgggtcataccaagttcgcacctacaagaattccatagtgagacctatttccacccacgtgacttccagtgcacagatattcagctgggtgtatctaaatgtcactgcacagcatttgtgaatggttataaagaagaaaaatgatacaacatgctgctttgaggccattggttttttcctttttttcttttttgtttttacctcctaaagttcaaaattagaactttgtttaattaaatacacatcttcatctaggcttatgttgttagagaaactcctgtttatcttaatatctctgaaaccaggatgtgtcttatggtctctgtgagccagactcatgacgtagttaccattgcctgtgatgggtgaatattggttgtagttgttcacctcatcatctctccatttgaggcaaatgcatcattggtgctatgtgtatttaactgctgttttaaaagccttcacaaagatttactgtgatttagcattgaaacaaaaagttgttgtgtgtgcagaagggcaagcagaccagcaggccaggaatttgatattcatggaacaaatgtcatcattgtgagaatggtctccattccatattccaaagcaacaaccaagttctacaacggaacaaaggaaagaagacactcacggagcagttgaaactaggtattttgttgctgagatgcttgcaaaaagat

SEQ ID NO: 88292 - DNA, 3027 bp, Homo sapiens
  misc_feature (1615)..(1615): n is a, c, g, or t
  misc_feature (1749)..(1749): n is a, c, g, or t
  misc_feature (1945)..(1945): n is a, c, g, or t
ccagtgagagctagaaccaagtgccagcccccgggggtgcacccgtgctggtgtggggccacgtggtccttgtggtccaggcagggccagcatgtggcggggtgtccagctccactgtttggaggaagtgggcgctgacacagcagagtgccctgggcccgtggggatttccttccagaggacacgtggctgaaagcataggataaggatgtataggtgaatgactggtgccatccctggctgtctgatagatgcaggtagggcaggtgaactgttgctggcctggccagcaggcctagggtcacatggtgattggcgtcctcctgccaccccttctccatgccagggtgcctgtggtgggtttgcccagcacgcatgaccccaggtcccaaggagagtgtgaactgaggcctgggtggtgaaggcagggcctctcctcagccctgtgtcctgtgggtgccagccagtcccatctcgcattttggggtgccctttccctgctgccaggggactcttcatttgtccttaccctagaatcagcccagacactggacatcacccagacgtggcccttcaggaggtgcacagggcaggggcaggcccgtccctccctgccccaatttgctgggctgcctcagcccagggtctggccttctccttggtgaaggtctgctgggcccctgtccacctcctgctgggaggaggagatggggagaggaccaggaggacaccggaggccctgtcccctgcactgtgagctcagtcaggtccatgagctgcccaccgtcctggccttactgtgccccctgccccaccaacataggtgaaagcacctcccctctaaggaagaccatagagaccccaacactgtgggaccccaaagctccttcatgctcactggagctcccaccgtgggtgcttgcaagtcctcagcgctcccggggtacagccctccccttcctgccctctaatgtcctcccctcccttgcccttccctccacttcctttctctgccgtcccctcctctcccatcttgtgacctctttactggcggggcctggagcccatgatggacacttgcggaaggaggggtggcggagcacccctgagatgacatcgctgcctgccccagagcaccccgcctctccctgtgactcagttctttgcagcccagatgtgagcatgtgcaccctgggacctgctgcccgttgggatgcccaggccaaatcagcccctctgcctccatgctgcactgattgcaagagtttcccacatctgcagaggccgtgggctcagccccacaccagccaggccaccagtgttgatagcggtgaggcggggacaaagggaatgtctcagttcacagtgtggacatggtggaggtctcggccttgcgagacaaggcagggggaggggataggaaattgggggtattctgtgactcctgggccaccggggagccagaatcttccagccagactggatgggcagggcttagcttcctgatgccgcccattcaccactttcaccccgggaacctacctgggcatcatgggaggcagagcctgaaccccaacccaaccctaactctaatgctaacccctaaaccatcccncaccctaacccaatcctcgccctaaccctaatgctaacccctgacccgacccaatcctaaccctgatgctaacccctgactcaactctcaccctaaccctgatgctaacccctgacccaatcctcaccctaacnctgatactaacccttaacctaacccaacccagccctaactccaactctaaagctaactcctaaccctaggagaggagcccaggccgggccctctccctgctggtttcctgttgggctttggagccccagatgcctgcccagaggcttccttgtgcggggtggggtccagcagtgggggatgggcccagagctggtntagccaccagcagagccatcctgatccacaggaccatccctggtggggtggggccccctggggcaggaaggccactgaggccagggagactcccaggcccactcacggcgcaggccccacaggagctggctggaggctatgggtgcggggcgtgggcctgccgggggttgcgtgacaggcagtggggagtgggttgtgctggcagctgtgggtgagtgaggaggctcctctcatgaagggccctggggaagtggaatctggccctgagagacccccggcctcctctgcaggggctgccggcaggaggggaaccggggaccacctcccgccacagagcctggggcccccagccttgcctacagggagggtagatgagagtgtaaactgcatatgaggttgggctaaacctggacatgtgtttcataaccaaagcagccaggaatctccggctctgcccagtgatcatctgggcaggacatggggacgagtgtccaggctgaagtcagggcccggccagcagagggccattttgtattgagctccacagctggtcacattctgtggaatgtgcagacgtgcacggcccatcagacagggtctggagtggggctgccgtcttgggcagctcctcccgggtgtctgcaaaatgcagaggtcaccagagccaaggcagcaaggcaaggagcccggcttctaaggaactctgagcaggtgtggtccatggctgggaggcagctggccccacagcacatagcacggagggcggcgcggagtcctggacgctcttggcaggtcccctcatggaggatgtgggggattggcttaggcctggtctggctggccttcctggaccgcagtggccaggagctgaaaaccgtgaccccagtctccctgcagctgttcttgatgggatttctgttcgccagtcagatgcatttgcacaggacttggatcctgaactgtgtaacctggagaggcaggtgtgagcgggccatgctgctggcccagcctgtgccggtgtctgtttctgttgtctctcggcccttctgtgagccctcagtaaagctcttcgtgcttcagtc

SEQ ID NO: 88293 - DNA, 3629 bp, Homo sapiens
  misc_feature (1615)..(1615): n is a, c, g, or t
  misc_feature (1749)..(1749): n is a, c, g, or t
  misc_feature (1945)..(1945): n is a, c, g, or t
ccagtgagagctagaaccaagtgccagcccccgggggtgcacccgtgctggtgtggggccacgtggtccttgtggtccaggcagggccagcatgtggcggggtgtccagctccactgtttggaggaagtgggcgctgacacagcagagtgccctgggcccgtggggatttccttccagaggacacgtggctgaaagcataggataaggatgtataggtgaatgactggtgccatccctggctgtctgatagatgcaggtagggcaggtgaactgttgctggcctggccagcaggcctagggtcacatggtgattggcgtcctcctgccaccccttctccatgccagggtgcctgtggtgggtttgcccagcacgcatgaccccaggtcccaaggagagtgtgaactgaggcctgggtggtgaaggcagggcctctcctcagccctgtgtcctgtgggtgccagccagtcccatctcgcattttggggtgccctttccctgctgccaggggactcttcatttgtccttaccctagaatcagcccagacactggacatcacccagacgtggcccttcaggaggtgcacagggcaggggcaggcccgtccctccctgccccaatttgctgggctgcctcagcccagggtctggccttctccttggtgaaggtctgctgggcccctgtccacctcctgctgggaggaggagatggggagaggaccaggaggacaccggaggccctgtcccctgcactgtgagctcagtcaggtccatgagctgcccaccgtcctggccttactgtgccccctgccccaccaacataggtgaaagcacctcccctctaaggaagaccatagagaccccaacactgtgggaccccaaagctccttcatgctcactggagctcccaccgtgggtgcttgcaagtcctcagcgctcccggggtacagccctccccttcctgccctctaatgtcctcccctcccttgcccttccctccacttcctttctctgccgtcccctcctctcccatcttgtgacctctttactggcggggcctggagcccatgatggacacttgcggaaggaggggtggcggagcacccctgagatgacatcgctgcctgccccagagcaccccgcctctccctgtgactcagttctttgcagcccagatgtgagcatgtgcaccctgggacctgctgcccgttgggatgcccaggccaaatcagcccctctgcctccatgctgcactgattgcaagagtttcccacatctgcagaggccgtgggctcagccccacaccagccaggccaccagtgttgatagcggtgaggcggggacaaagggaatgtctcagttcacagtgtggacatggtggaggtctcggccttgcgagacaaggcagggggaggggataggaaattgggggtattctgtgactcctgggccaccggggagccagaatcttccagccagactggatgggcagggcttagcttcctgatgccgcccattcaccactttcaccccgggaacctacctgggcatcatgggaggcagagcctgaaccccaacccaaccctaactctaatgctaacccctaaaccatcccncaccctaacccaatcctcgccctaaccctaatgctaacccctgacccgacccaatcctaaccctgatgctaacccctgactcaactctcaccctaaccctgatgctaacccctgacccaatcctcaccctaacnctgatactaacccttaacctaacccaacccagccctaactccaactctaaagctaactcctaaccctaggagaggagcccaggccgggccctctccctgctggtttcctgttgggctttggagccccagatgcctgcccagaggcttccttgtgcggggtggggtccagcagtgggggatgggcccagagctggtntagccaccagcagagccatcctgatccacaggaccatccctggtggggtggggccccctggggcaggaaggccactgaggccagggagactcccaggcccactcacggcgcaggccccacaggagctggctggaggctatgggtgcggggcgtgggcctgccgggggttgcgtgacaggcagtggggagtgggttgtgctggcagctgtgggtgagtgaggaggctcctctcatgaagggccctggggaagtggaatctggccctgagagacccccggcctcctctgcaggggctgccggcaggaggggaaccggggaccacctcccgccacagagcctggggcccccagccttgcctacagggagggtagatgagagtgtaaactgcatatgaggttgggctaaacctggacatgtgtttcataaccaaagcagccaggaatctccggctctgcccagtgatcatctgggcaggacatggggacgagtgtccaggctgaagtcagggcccggccagcagagggccattttgtattgagctccacagctggtcacattctgtggaatgtgcagacgtgcacggcccatcagacagggtctggagtggggctgccgtcttgggcagctcctcccgggtgtctgcaaaatgcagaggtcaccagagccaaggcagcaaggcaaggagcccggcttctaaggaactctgagcaggtgtggtccatggctgggaggcagctggccccacagcacatagcacggagggcggcgcggagtcctggacgctcttggcaggtcccctcatggaggatgtgggggattggcttaggcctggtctggctggccttcctggaccgcagtggccaggagctgaaaaccgtgaccccagtctccctgcagctgttcttgatgggatttctgttcgccagtcagatgcatttgcacaggacttggatcctgaactgtgtaacctggagaggcaggtgtgagcgggccatgctgctggcccagcctgtgccggtgtctgtttctgttgtctctcggcccttctgtgagccctcagtaaagctcttcgtgcttcagtcagcaagtgtggattctgtcgtcggcaactctgcggcccaaaccccgagcctccccctcccccagaccttgcagtgccatggagctgagggacctgtggatccacagctgtggccccggaagggctgcaggagctgaacctgcgtgagccccgcagagggtgcagagccggcttgtgcaggctcccagcaggctcatgacagcgcggatggttaaatgtagctcctgacagccaactgttaaggtttcaggcatttttgcaccaggtgacatgatggtagcctgaacgtgaccttggcagcagtctctacatcaaggaaactggcaaatgtcaacatgctgggtaccctcgctcctgccgccgcaggctgtcagtgtcttccagcccacactgcggggggccttgttgtgtggctgcctcccaggctggggcgagggtctccagagaccaccatcgtgcaggctcttggtcaatagcagggtgtggtgctcctgccaggggacgcattctccgtgtgacctctacaccccaggtcaggtcaggatgtgatttgcttctccagggccgtgactcactagatccacctcccactggtgcctggtg

SEQ ID NO: 88294 - DNA, 245 bp, Homo sapiens
aatactagaggacacttgaaaattacatgaaattcaaatttctgtgtccaaaataaagttttattggactgcagccatacttgtttgtttacatcttgtctatggctgtggcagcatggaattgttgaaccaaagactgtatgcccacaaaacctaaaatatttacagcaaaactactgcagacctctgatttaccccagtttaacatacttcaaattttaaataaaaatttgttcacttaaagc

SEQ ID NO: 88295 - DNA, 936 bp, Homo sapiens
aatgatatagctaacatttatgttccaggcactatgctaagcagctttacctatattacctcatgtaatcctcacaacaactacaggaagtggataattactgtccttactttacagttaagaaattgaggctcagagaagttaactgtcccaaagtctcagagctagtaggagacaaaggtgggattgaatccacacaatcagattccagaggcagcacccagaatcactatattctattgccttttctgggtgtctgtctgaatttgatattttcaatttggtggccaggggtcatggtccatgtgtatttttctgggaaaaaggaccttggttttcatcatgatttcctaaacagcaatctttgaccccagagattaagaaccactcctggagcctgtgtggtttgaaaagcactggccagcagaaatcccatagaactgctaccatcttaccatgtgatttggcacacctcggttgtgtctgtcatatgaagtgtaaagatggcatgccggcaggccctcccccctctgacccccttttcccaggctcctgttcaagggcagcatccaggggtaggaggaagatcaggttgcttgggctcagtgagacagcaggtcagtgggaggtgatgatgaagggagggagctgtcagttcccaggagcccttaaggatgagcactgagggttggacccagaccgaggtaagcccttaaccaatccttccctgggtgaagatgaagagggaggccccctactgcagaaatggaaacaccaaggtggtagctctagatctaccccctccccatgccagcctacctcaggactagagcttggctgggggctgctggccatactcccccagtacctgaagcctgactgactctccacacctgttccctaaagatgctcaacggttttgctgctgagacactt

SEQ ID NO: 88296 - DNA, 397 bp, Homo sapiens
tatgtacttagtatttgtggactatattttatccagcattctgtatatattagtagtgggataacatcagctactcattgtggcacattgttactctggaaggcttgaacaggaatactcttattattgaaacaaaaattcagaaaataattaaatttatatgtgaacttgatattatttgcatgcaacatcaataccatttcagctaaacatcatctttcttatgaaattaatgttattaatttgaatgtcaatgtttttgtaatttttaaatatatttaatttgtgaatttatattaatttaatagttataaaggagttatatgcataatagtttagatctaattttgttagtatgtatttatatggcattaaaatatgagtatttaaagcaaca

SEQ ID NO: 88297 - DNA, 242 bp, Homo sapiens
ccttgcacaagacagtatgagactttctcctttgaaataaccttcagagtctacagataactcattcattccttcactccacaaacactgactgactataatgtgtctgacttactgccacctggtgctggactgttgtgaatagtctcactgcagctcgatctttgatcactgtacctgaacttgatttttgccctctccagcccaggacaaattgcttcccgaggctcattgcagttcca

SEQ ID NO: 88298 - DNA, 229 bp, Homo sapiens
gcaacattttttggtgtatttttcttccactctcttttgccaagattaggattttgtgtgtgtgtgtgtgtgtgtgtgtgtgcagttctctgtgtaaaactgtattaactatacggcattttttaaccccactaatattttaacaaaagaatttactaacgtagttacatgaagtcgttaaacattttaatgactacatagccattcacattttcccattttcctctgt

SEQ ID NO: 88299 - DNA, 507 bp, Homo sapiens
cgtgtttttactggagacagagtttcaccatgttggccaggctggtctcgatctcctgacctcaggtgatccacctgccttggccttcccaaagtgctgggattacagacgtgagccaccgcgcccagcctagaagtgatttttgtcaggagacagaagacctttagtgattggagtcaagcaggtggagtgtgaagatcagctctgccctttagctgtggaaccttgagcaagccacctcacctctccacgcctctgttctgtcaccttttggagatgaataatgcccatctcacagggcagctgtggccagtgcatactgccatgcctgtaaagtgcctactgcacagcccaggacatagaaagatggtaactgaggttttgttgtggttgttcactagcattgcataggacccaggtctgatcccttcattcagctggtgtgattgtgagtcaaggatctgatatccccaaagaaaggactgcaagtatttgccagtcagactt

SEQ ID NO: 88300 - DNA, 375 bp, Homo sapiens
aaaacatgcataagatctacttgagaagaactactcaactctgatgaaagaaatcaaagaaaaactaaataaatggaggcattccatgttcatagataggaagattccattttgtgaagatgtaagttatttcaaacttaacgtgtagattcagagcaatctcattcgaagcctcggcaagttctcttgtagctactgacaagctgattctaaagtttatatggagaggcaaaagactcagaaatagccaacacaatattgaaggaaaagaacaaagttggaggattgacactattctactttaagacttgctataaagctgtaataatcaagaaggtgtggcattggcaaaagaataaacaaatagagcaatgt

SEQ ID NO: 88301 - DNA, 441 bp, Homo sapiens
gtaataacaaaactccagtctcccacacagcaggctctgcatgaattactctttctccattgtaattggcctgtcttgataaatcagctctgtctaggcagccagcaaggtgaacccattgggcagttacagtagcaagtattcctacaccttcaagcaagatgctatctggacaaagtaagatatggtgaaagctgtcctgcccccagttatgactgctcacctcaagcctattcaacaagctgaagaggctatggggagattcttttgaagcccgtgctgcagtagtctcttctggcattccattctccactgggagatgaagaagcactttttcctaccttagactatttgagaagggattaagacatttaggataatatgtgcctctagaggttagtgcgcagtgattggctagatttcctaaggcagcagaacaga

SEQ ID NO: 88302 - DNA, 276 bp, Homo sapiens
tgggggtgagacctgccttttggggctgaggatgaaatgagatgacccctgtgaagactttagcccagggccagggacttgataggtgcataatcaggattattttgatggcagttattggtccaagggtcgatggggggccagtgagagtccaggagcagcaaagccacttctggacttctgggaacatggacggctgggcctggaggctccgggcaggtgcaggaggaatgctggccacactcgttcagtcttcagtctctgcctggcccagct

SEQ ID NO: 88303 - DNA, 454 bp, Homo sapiens
attaatccatccgcattccaaaacaattaattacttaagaaatccaaccagcacacatctaaggcgaagctgcttctttggtagttttttattctacagagtgctaccactgtacaaacagtcaagcgttttggttggcagacaataataaaataagctttatttccttttcttcttcccttagcaaaactccagtctgtcatcacctctgacatgcgccaagaactaccaggaatgatgaagtatatttcaaataaactttcctattaaagtgagtccttgtggttaacatcataccaaaatgctttacattttatccagcaaaacctttacacaccgtaaaaaaagaaatcttaagacacgagctcgtatctgtatttaataataaactcttatcttggccgtacttaccaaatcgtaggcttttactatttataagcctttgaaaaaactt

SEQ ID NO: 88304 - DNA, 277 bp, Homo sapiens
aattcaacaacttagatgtaatgagcatattcattgaaagacacaaattaccaaagctcattcaataagaaatcaataacctgaatagcagtgtacttatatataaacaaattgcatttgtagttcaaaatgtccaacaaagaaaactccagacctataaggcttcgctggtaaattctactaaacatttaaggaggaaataatatcaattctataaaaactcttttgtaaaatttaagaaaatacttcccaaatcatgtgaccagcattgtcatgg

SEQ ID NO: 88305 - DNA, 420 bp, Homo sapiens
gtagaatcaaaattttaactaagggacatttatattatatcttagtatcctgtagcaattttggttctgggtcaagaggggtatgtacaagaccagtttgacacccttaactctgctcaattggggagggtctattttcctttaagaggcaaagcctttggagaaggaaattgaggggactaaatgatttctgtctttcaagctccctcttcttgagatagagcaagctgaatccttgtttttaatttgctaatctggaaccattgaagtgtttgactggttataccagtttgcctacaaagagttgtcctgacataggcattttctcaactgatagttgaagctgtttaacctactttctcattccctggtgccagtaaagtaggagccctccttattccatggtctcttagctctagg

SEQ ID NO: 88306 - DNA, 497 bp, Homo sapiens
tttgaataagcacaaaattatctatttttgtcaagaacccaatttttcatgctctgcaaattgttttctgtttctatgtaaaaattttaattatactcctatactttattataaaagatactgatttgattagcatcctcttaccagaaacacatactagacatgagattaaatccttttgactatgaattacctaaaaatttctaagaaagacctgtgagtgatttagaaaactttatttggtaaagagtatgaaagtaggaatgatttattcttataattcagcctcgttagtaagaatggctcaggattgcctagagaaatgcccaaatattgttccaaaagttactttgaactattaatattgagttattttcaatgttttcattcagtgaatttctcaacccttggttttgagaacataatgctaattaaagtgtctgctgttgtttaatgctattccattgtaactgctaataataatagcatttttctgc

SEQ ID NO: 88307 - DNA, 771 bp, Homo sapiens
gcacagactccggagctggctactgcggtaaaaacccaaccgtctgcctgctggctgtaggaccatggattagttccataacttctctgtgccttatcggtaaaatggagatagtaatgatacctgtctcacagtgtcgtaaggattagaagagttaatatttgtgaagaacagagcatggcagatagtattataaaagtgtttgttaaatagaattagtaaaattgaaaaggttcactctgctgttatatggaaagtgtttgccaaggggaagtaaggctagaagtagaaagaccagttaggagataattgcaacaatccgtgcaagggatggcttagatgaggtgctgatggtggaggtggggaagtgaggagaagggtcacatcctgggtatattttggcggggtggctggaggattggatctgcttttctttccatcctggaactttccaagttttctttgctgccttgtctgctccctcttgaacaggggttctccagtggggtggtgccattccggaatatgtgggtgcatgttttggttgttgcagactggagagatgggtatttctggtatttagtggccaggggctgggccaggggtactcagcatcctatctggtgaagacttgttccttgaaatgtgccagtggcatcctggatgagaaatgctgctttagacctttatttccccgacccccactcacctcccgtctctgctcgctcacctgcctcctcaagatttcttaacctatagtccctgtgtggg

SEQ ID NO: 88308 - DNA, 660 bp, Homo sapiens
agagacgcagatttcagatgtaagaagcccgatccacattgcataagtggacccagctgccagatgtgtgggcagctgcagggagtggcccggggtgctgggcccagctgtggttgttcttttctgggtcaggagtgactgcggagtggctgggacgctcctgccgggggaccctcctgccgggggtggccgcttgcctgggggaagacccctttccctttctttttttttttgaggctcaaaaaaaaaatccaaataaagcaccatattcccaccacgccaaattaaccttgacaacaatgttggcgtatttgcgtccagtgctgtttttattaattaaggtaaaatttacatatggtgagatgcatgctcttcagtggagacccagcccctagaaggtccctccagcccttcctgtcggcgtccctccccatctgtggctctgacttaagcaccgtggattgacctctccggctcacgaccttcgaggagtcagaatcctgcagttggagcctttgatgtctggcttcttcatcctatgacttagagcttcatccgtgctgttgtgtgtgtccgtagctccttgctgtctgttccttcgtttttaattgtgagcagtgttcttctgtctgaataaactaagacgcagtttgtccatca

SEQ ID NO: 88309 - DNA, 343 bp, Homo sapiens
tggattgacctctccggtgcttaagtcagagccacagatggggagggacgccgacaggaagggctggagggaccttctaggggctgggtctccactgaagagcatgcatctccccatctgtggctctgacttaagcaccgtggattgacctctccggctcacgaccttcgaggagtcagaatcctgcagttggagcctttgatgtctggcttcttcatcctatgacttagagcttcatccgtgctgttgtgtgtgtccgtagctccttgctgtctgttccttcgtttttaattgtgagcagtgttcttctgtctgaataaactaagacgcagtttgtccatca

SEQ ID NO: 88310 - DNA, 697 bp, Homo sapiens
cacgaggtttaatttaaactctgatggagagatttcagtttaaattctcagttttttacccctttttcttccagtcatctttgaggtagcctttgttgctttagaaccaagctgacaaaaatctcagtatgtacaaaatgtttatgaatttactcttgtgtccagggacttaaatgtatatgagaatggtgcaggcagaagggaagacactggctgcaaggctgacaaacatactctgtgttctttttttgtggcaaaaaacaggaaaaaaatagtagctaaaattaggagctctgttctcagactgcctgggtctgaatcctagatccaccagtggtctggttaactcaaagaattatttaacctctctaagctataatttcctcatatgtgaaacaaggataaaaagagtgtctgttttatagggttgtgaagattgaaattatcaaatatggtgcttggaattgggtagagacactcaatatatggtagttggtagcattgtaggaagtgaatagtaatagtcattttccattaatttatttacatgctttatcttgtgtaattgttaaaaaatatcaaatgcgttcctatgtgtcaaaaggcctaaatagccctgtgtacctaaaagatggtaattaattttggtggttggtttgggtgaaaatatctgtcactatttcaggaaaatacaaaa

SEQ ID NO: 88311 - DNA, 320 bp, Homo sapiens
tgcaatgttacaggagaggggtcctgatccagaccccaagagagggttcttggatttggatcctgtgcaagaaagaattcaggtgacttagaatgcctgaccatgtgggaatgcagcccagtaggactcagtctcattttacccagcccctgttcaagatggagtcgctctggttcacacgcctcagacacagcctctgcctcccgcctcagcctcctaagcggctgggactacagtgcatacctgattttctcgacctcttttatgaaatatccccgccagactccctcgaccgtgccacccccaggttcccgtgcata

SEQ ID NO: 88312 - DNA, 607 bp, Homo sapiens
cagacagagctgctgcccatccttgcaacagctaggggctgaactcctgctctgctgagttttgggtttattctctaacctgtggcaatgtgctgtagtcagcccgacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaat

SEQ ID NO: 88313 - DNA, 364 bp, Homo sapiens
tccttgaaagcttatggttattcatagtctaacaaaactagggtcaccaaacttggcagcagaaataatctagtcttactgtgataactacccaattactttattatttttccagttgcagttcaaaatgttttgtggaaatattttttgctgtttgtgattttcaaagcttagaggggaaaacaaactttccagtgttggagagcactgaatagtttatgaattgtgtaaaagagtcagatttcaatgcaattatcttttcctagacatttatccaacattaaaaacctatgattataaaaagtaaaggcttaaagtatatttcaaccacagctaggaaatgtaaagttaaatctagcttgtg

SEQ ID NO: 88314 - DNA, 109 bp, Homo sapiens
aggtccctgacttttctggagcataaccagacatgtggttggcttcttgagcaactcatttcgaaaatgaaaaggaacaaattacttttcttttggcaattctttacta

SEQ ID NO: 88315 - DNA, 504 bp, Homo sapiens
gcagtttataccaaactaacgctttaatgcagtgcttttcaaacttcagccttcacataaaacagcttgtacaccgtaaagcttcagatgcaggctctgattcagtaggtctggggagatgcttgagattcagcatttctagcagctcctcaaggaggggattctgggaactgtaagaccacacttggagtgtcaaggttttgcagcatgtttttcatattccagtatagattgccaggagtgcatttttaaagtgcctttttgttaaataatataaaaactagtagaagaaccattagtggtggcaaaggagtaagagttgaatgggccagctctgggtgggcccagccagggtctcagaacagaaggttcttctaaagctcttctacgtggatatggggagtatcaggccaatagagtcctttagggttcccttgtgcctattaatccaaacctctggggaatacctttcaggatccatccacattctaaactccactggaa

SEQ ID NO: 88316 - DNA, 645 bp, Homo sapiens
tgtctgcctctgaggtcagacgctctgcactgggacagcgtggagtggagggaaaccaagcttggggctcattggaggggcttgctggcagacaccgccctttgtgggaaactgactgtgggagaggggaaccccaacctctgtcaccacatccctcttccctgttgtcacacctgtcacctgctgccgtagccatgagacttcccaagggtcactgctgccactcactgcacagcctggaagggagtccacaggggacatacagtgagcaagagacctgtgccactcaggcctcctgggggtgtccccagtgcagccatgatgataatcacagctaccattcaccaagccctgcccacagtctaacctactctattcacaacactcccagcagcaaggcaagtgaggtgctgccgtcatccaggctggacagttcagtgatttgcctgaggccccacagcaggtgagtggcaagtccagcgtcagagcagggcaggctggcggtgccccctgagccccctttgccatgcttaccgcatgcacatcctgggcttgtgcaggaatgccctgtcccctacctgccctgctccgtgcaaaaccctgtgcctgggagacatgctgagagaattcatggaaacaaatgtg

SEQ ID NO: 88317 - DNA, 292 bp, Homo sapiens
ggaaataactaagatcagagcaaaactaaatgaaattgaaacaaacaaacaaacaaaaaaataccaaaggtaaataaaacaaaaagctggttcttcaaaaagataaataaaattgatagaccattagcaagatcaaccaagaagagagaaaatccaaataacttcattaagaaacgaaacagaagatattacaactgacaccactgaaatacaaatgatcattcaaacctacaatgaacatctttacacacataaactagaaaacctggaagaaatgaataaactgctggaa

SEQ ID NO: 88318 - DNA, 279 bp, Homo sapiens
ctagggtgtctgtacagagtcctgtgatgtgagcttctgttggattctcagcgtggataccaacgcctgttccagtggaggtggctgtggtgtgcaggggactctgtcagggttcttagtttggcggtttaatgctttatttttgtgctggttggcctcctgccaggcagtggcactttccagagaacatcagctgtagtagtatccagagggaccagcggtgggcagggccctagaacgcccaagattatatgtcctttgccttcagctaccaaggtg

SEQ ID NO: 88319 - DNA, 161 bp, Homo sapiens
acagatacgctcgagctcggacatcttgctctactttctgatacttggtcacagctgcagttttacatttgtcatatacttaacatttacctttccactagaaggtacacttctgaggaccagggtcatccattggccccagcacatggcctaatatttag

SEQ ID NO: 88320 - DNA, 1935 bp, Homo sapiens
gtctcttttgagttttctatactggacatttcatacaaatgcaatcatacaatatgtggtcttttctgactggcttctttcatttagcttagtgttttcaaggctcatccacactatagcatgtttactacttcattcttttttatcgctgaatacaattccattttatggatgggccatgttttatttatccattcataagttggtgaacatttgggttgttttctctttttctgttatcttatgggtgtaccatagtttgtttaaataacttaaagaacaattttaaaaaggtaagcctggtcatgaatactgtctcaaagaaagtaggcttttgctagattggtattttttaacaaaataagttaggccttttaaaattccatggctagaatctagtagaatccagggagcttgtctctccatctatccatctcttcatccatctgtccatctaaccattcattcaggcaactatccgtggatcctttaagcatcagatatgtgctaggtagtggagacacagagagcaactgatttcactaggtgctcacagagtgtgggcatgggagcaggagggcagatggacatgtgtgttagtcagctcaggctgccgtaacacaataccacacactagggggcttattttcttatagttctggaggctagaagtacaagaccaaggcactggtagagttggtttctggtgaggcccttcttcctggcctgtctagttgccttctcactttgttctcacatggcctttcctctgtaagcaggcaaccctgatgtctcctcctcctcttataaagacaccaggcttattggattagtgccctcccattatgacctcatttaatcttagttacctcctttaaagccctatttccaaatatagtcaccctgggggttaggttccaacatacagatttaggggagacatacttccatctataacaacatgtaaacacggtcattggagtgatatgtgtctcaatagagacaagtctgtgacatttggaagtccagagggggagcttccagttccctaggaggttgagggacacttgaccatgaagggccgtttagggtgtgtgttgaaaaatcaataagagcttaccatgcggcttgagtaaaggctaggaggatccatgtgtgtagagctccttgctgggggtgtggtttcagggtgaagtgccaatggggaggatgagggaggaggagaaataagatgaggctggacccaggtgggcatttatgtaattgtcaaaatcagaatttatccgaagcagagtgaatgggaaggggagtgtagacctggaacaggaactctttctggatgcttcactgaagaggagagagattgagtgatggtgagcgggaggaacaatggtcaagggaggttttcatttttaatataattcttgtgcaatattccatgcatcagagtattataaggtctgtgtatggttagaagaagaataaaatgaacatgatttacccatcaccagagagaaacaaggactttgggggccctcccgttcccttccatgcacatctccttcctgcttcccagaggtaaccactttgttgactcaagtgtttattatttgagaaaggtttttttttaaagcccttgattgggtgtaaagctatcatttaactaatttcctgacattctcctagttttgttttgttctgacacatttttaaagttaagttttatgtcatttataatgatgctaaaagcattttggcaggagctaggttaattctctgtagccttttctcttggcacatgtgaaagagaactgctggttggcgggtggctcacccctgtaatcccagcactttgggaggctaaggcaggaggatcagtagagtccaggagtttgagaccagcctgggcaacatagtgagacccctatctctaca

SEQ ID NO: 88321 - DNA, 1422 bp, Homo sapiens
gtctcttttgagttttctatactggacatttcatacaaatgcaatcatacaatatgtggtcttttctgactggcttctttcatttagcttagtgttttcaaggctcatccacactatagcatgtttactacttcattcttttttatcgctgaatacaattccattttatggatgggccatgttttatttatccattcataagttggtgaacatttgggttgttttctctttttctgttatcttatgggtgtaccatagtttgtttaaataacttaaagaacaattttaaaaaggtaagcctggtcatgaatactgtctcaaagaaagtaggcttttgctagattggtattttttaacaaaataagttaggccttttaaaattccatggctagaatctagtagaatccagggagcttgtctctccatctatccatctcttcatccatctgtccatctaaccattcattcaggcaactatccgtggatcctttaagcatcagatatgtgctaggtagtggagacacagagagcaactgatttcactaggtgctcacagagtgtgggcatgggagcaggagggcagatggacatgtgtgttagtcagctcaggctgccgtaacacaataccacacactagggggcttattttcttatagttctggaggctagaagtacaagaccaaggcactggtagagttggtttctggtgaggcccttcttcctggcctgtctagttgccttctcactttgttctcacatggcctttcctctgtaagcaggcaaccctgatgtctcctcctcctcttataaagacaccaggcttattggattagtgccctcccattatgacctcatttaatcttagttacctcctttaaagccctatttccaaatatagtcaccctgggggttaggttccaacatacagatttaggggagacatacttccatctataacaacatgtaaacacggtcattggagtgatatgtgtctcaatagagacaagtctgtgacatttggaagtccagagggggagcttccagttccctaggaggttgagggacacttgaccatgaagggccgtttagggtgtgtgttgaaaaatcaataagagcttaccatgcggcttgagtaaaggctaggaggatccatgtgtgtagagctccttgctgggggtgtggtttcagggtgaagtgccaatggggaggatgagggaggaggagaaataagatgaggctggacccaggtgggcatttatgtaattgtcaaaatcagaatttatccgaagcagagtgaatgggaaggggagtgtagacctggaacaggaactctttctggatgcttcactgaagagggggagcttccagttccctagagcttgaggacaacgaatgttcggtacagaactcgagttgtatata

SEQ ID NO: 88322 - DNA, 1200 bp, Homo sapiens
gtctcttttgagttttctatactggacatttcatacaaatgcaatcatacaatatgtggtcttttctgactggcttctttcatttagcttagtgttttcaaggctcatccacactatagcatgtttactacttcattcttttttatcgctgaatacaattccattttatggatgggccatgttttatttatccattcataagttggtgaacatttgggttgttttctctttttctgttatcttatgggtgtaccatagtttgtttaaataacttaaagaacaattttaaaaaggtaagcctggtcatgaatactgtctcaaagaaagtaggcttttgctagattggtattttttaacaaaataagttaggccttttaaaattccatggctagaatctagtagaatccagggagcttgtctctccatctatccatctcttcatccatctgtccatctaaccattcattcaggcaactatccgtggatcctttaagcatcagatatgtgctaggtagtggagacacagagagcaactgatttcactaggtgctcacagagtgtgggcatgggagcaggagggcagatggacatgtgtgttagtcagctcaggctgccgtaacacaataccacacactagggggcttattttcttatagttctggaggctagaagtacaagaccaaggcactggtagagttggtttctggtgaggcccttcttcctggcctgtctagttgccttctcactttgttctcacatggcctttcctctgtaagcaggcaaccctgatgtctcctcctcctcttataaagacaccaggcttattggattagtgccctcccattatgacctcatttaatcttagttacctcctttaaagccctatttccaaatatagtcaccctgggggttaggttccaacatacagatttaggggagacatacttccatctataacaacatgtaaacacggtcattggagtgatatgtgtctcaatagagacaagtctgtgacatttggaagtccagagggggagcttccagttccctaggaggttgagggacacttgaccatgaagggccgtttagggtgtgtgttgaaaaatcaataagagcttaccatgcggcttgagtaaaggctaggaggatccatgtgtgtagagctccttctgtggtggcagaattggatcctctagatca

SEQ ID NO: 88323 - DNA, 178 bp, Homo sapiens
agaaaggcagtaatggggtctgacagagtattacgggtatcagcacgtggaattctgaaaatatattgaagcaaatataattaacccatatttcaccatcacaacactgcaaagttccctggcttctgatccctccctgagccactgactatgcaggcacagacactgtagggaaagt

SEQ ID NO: 88324 - DNA, 432 bp, Homo sapiens
tttaagagacagttcttgcttagtttcccaggctggtctcaaacttctgtcctcaagtgatcctcccatcttggcctcccaaagtgctgggattgcaggcaagaaccactgtgctcagcctggacgccatttctgatgcctggatatcatgcccttgtatgattaatttaagcctgtctccattgataattttggtttcttccagtttttcctctgctaaacaatacagtgttaaacatccttgaacatacttctgtattcatttgtagcagaacctctaccaatcactgttttggttatttccagttgttttgtttgatttctagctacaaaataacactggaataaatttcctcatctttgcacatttttttttttttttagaatttagcttttttagaatttagaaattttagaatttagcatttttgc

SEQ ID NO: 88325 - DNA, 406 bp, Homo sapiens
gtttttaatcttcatattattaagatgcataataatattttacagatgaagaattgagattcagagtggataagtgctttattagtaaatgacaaaggaaagatccaattctaggatctgaattctgaaccattatcttatactgagcaaaaacaaaaaacaaaaaacaaaaaacctgctgagaactaaggaggaattttccaaagtcacagaagccagtggtggctgagccaggacaagaggctacatgtcctacttcagtcgccagccccaagtcaagcagatttgaccatcttctcaccaccaccccaatctacccccaacagaaccttcagatgggttcagagagagaggaggcgttaatgtgtcaactctctatgtctgggccttgccttttgcccaggaa

SEQ ID NO: 88326 - DNA, 1757 bp, Homo sapiens
tctagagatcccccaggtcttttcccccaaacacacatacaaagctgagctatccaggaacacaagggaaacaaggagattgtccagggtgggagcggaggcagcgggggaagaagactggaagcagagacctccccccttgtggggggcagactggcacaacagctactttagtgcaattggagagggtgcccagagtgagaggtggagaagggagggaaggcggtccccaacttccctgggggcaaagtcaggcttccagattccccagggaaagggcctagcaggagtgggtgagggccaaggtggatcctctggttacccgccaccctctgccctcccaaatgcagtgacagtgtccccctcacacctaagtgggcaacagcagccttggagtcagtaccttcaagtaattcaaagagcagaccctccccaccccagcttcaccccatctctgggatttggtcgcttctctaggggttgggttgggaggagggagcccccaaggcagacccttccctctctacctcccgattcccagaccactgggcttggtcctcaaagattcctcacctccgcccttgcccaacctgggtcaaggctgcagaaggctggagccaccacaattagaggggaaggggctgctttgttccttatccctccttcttaaaaggtagggttcaaactaggcgggatgggggcccatactggtttgccccaggagtagggtttctgggctagggtctgtaaggctattttcctttgcggtgggaaggggaggtaggggatgaacactgggtatgggaagtgggtgagaaatggctgagagggaaggaggaaggggcctccccgctggagcagtcactggagtcatttagacaaaaacactcatgtgcataagatacacagtgcgcaaactcagccctgccagcccggccccaatcccacctctcaggactccttccaagaccctggaggaggttctggggatacagctgtagaaccgttcactctggccccatccaccccacctccagcctcttctccccttctaggtccagggagtaagaaggtgctcgggtgggcagacagtggtggaaacagtattgagttttcctttggttacatattgaaggcaaaggtgagctggacttacagtcaaaacggataggggtgaggaaggaagaggggccatggctggggttggagagggaggtaggccctcctcagcccctccaccccaagaaacacatctacgtggggtggcagtccctcagtcttttctctcccacgccccacagcaccaaacaaaaggagaagccccctcccccaggggctgctccccaccccaacctgggctgtacattcagtggttttcagcagtcctatggctcagggggccacggggcaggggaggtggcccgtcagtctcagtggacagtggcagtgacccgggtctgctggtccttcctgggacccacggtttgtgccattcgtttttctgaaggatagtatatgaccctaccagagccaccgcccaatcagaaatagctcccccaaaatcagaaactaaaaactggctctttccatctcaccctctgattcacacgtctgtttccctgtctcctatgtcgccctcgctctgtttcctttgctgggacctggggctgctcccagggtcctcgcttaaaataggccttttcacaaaagtgcttattacttgaagcaagtgtataggctagcgtgggtgagaggac

SEQ ID NO: 88327 - DNA, 477 bp, Homo sapiens
tttgaaggatggggtgtgatagggtacagaagtggggaaaaagctccaggccccagtgctaaatatcctcccccctcatcctctagctgcccctgaaggggggagggggacacccccagagtgctcacacagtaccagaaattaaggcttctcactgctgcggggatggagggaccggccgagcagggaggcagtgatgggtatggaagaagaggggatctgcctggcagtaggggcaggggagaagggggacacagagaggagtccccagggaagagtcgggggagctggcagcagaaagagggaaccaagagatggagtcaaagagtgggggagccaggcatttagcaatcattttgggacacttggcagaaggggtcgccctgggggtaccaagggcctggggtgctccctgtcagtcccagacccctgccaggccaagatggtgtggcaaaggggtgagcagctgctccccag

SEQ ID NO: 88328 - DNA, 3726 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatggtgagagatgtcgggtagagcagagaaatcaagggcagtggggaggcgggagtggagagggaggtagcagtccctccgcctctaccattagctcctggaagggcgtcagaccataggcccgcaaaagtctgagaaacaagggactaaggtgtttgggtgggggctgctgatgctttctgacaccattcctctggagttgagaggtcaggggcaaggccagaatcctgacatcctctttttctttcagctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaagccatgactacgacagttgtacttgcaccaaaacagcatagaaaaccagagtgtggtgggaggacccgaagccggttgggggaggatgtgagtaggggcctggagggtgcagggtcattaatctgcggggagaacattgtgctttagcccagggaggggaggggtggggcaaatgcaccgaggtccccactttttcctgctgccctcggcaccctggggatgcaggcatctgggcacatctgccccttattgctgcccaccagcgttaaacgcccccgatcccaacactagcaccacaggtggttccggggcagggagaggcaggaatgggaaaattgcttagagaaagattccactagaatccagtgaattgtgctcagttctctttacttcctacaaccgagtacatgggtcacagggtggagggtgcaacaggacatggaacatgcccctccgtgccccccaacacacacctgcacacaggatggtggtgtctgcagcatcacaggtcatgcagggcatggggaaggggaggttcacacacacatagatgcccacagcgggtaccagacggagaacacccctgaatatacatagctgtacatggggaacccccaggtccccaccccaaccctctcccctgtcttgctgtcccccgcaggggaactatattgctttgagagagccaccccaggggctgctctgccaggcaccctcccctcccacccacccccattttggcacatctgcaagacacacagcagcgagagtaggcaccctcccttcccaggcttctgtggcctggagctggagaagggggtaggagacttcatcctccatcctcccctaacccttcccaaacccctgccaaacccactcaagccagaacccacccccaccccccaaacacacatacaaagctgagctatccaggaacacaagggaaacaaggagattgtccagggtgggagcggaggcagcgggggaagaagactggaagcagagacctccccccttgtggggggcagactggcacaacagctactttagtgcaattggagagggtgcccagagtgagaggtggagaagggagggaaggcggtccccaacttccctgggggcaaagtcaggcttccagattccccagggaaagggcctagcaggagtgggtgagggccaaggtggatcctctggttacccgccaccctctgccctcccaaatgcagtgacagtgtccccctcacacctaagtgggcaacagcagccttggagtcagtaccttcaagtaattcaaagagcagaccctccccaccccagcttcaccccatctctgggatttggtcgcttctctaggggttgggttgggaggagggagcccccaaggcagacccttccctctctacctcccgattcccagaccactgggcttggtcctcaaagattcctcacctccgcccttgcccaacctgggtcaaggctgcagaaggctggagccaccacaattagaggggaaggggctgctttgttccttatccctccttcttaaaaggtagggttcaaactaggcgggatgggggcccatactggtttgccccaggagtagggtttctgggctagggtctgtaaggctattttcctttgcggtgggaaggggaggtaggggatgaacactgggtatgggaagtgggtgagaaatggctgagagggaaggaggaaggggcctccccgctggagcagtcactggagtcatttagacaaaaacactcatgtgcataagatacacagtgcgcaaactcagccctgccagcccggccccaatcccacctctcaggactccttccaagaccctggaggaggttctggggatacagctgtagaaccgttcactctggccccatccaccccacctccagcctcttctccccttctaggtccagggagtaagaaggtgctcgggtgggcagacagtggtggaaacagtattgagttttcctttggttacatattgaaggcaaaggtgagctggacttacagtcaaaacggataggggtgaggaaggaagaggggccatggctggggttggagagggaggtaggccctcctcagcccctccaccccaagaaacacatctacgtggggtggcagtccctcagtcttttctctcccacgccccacagcaccaaacaaaaggagaagccccctcccccaggggctgctccccaccccaacctgggctgtacattcagtggttttcagcagtcctatggctcagggggccacggggcaggggaggtggcccgtcagtctcagtggacagtggcagtgacccgggtctgctggtccttcctgggacccacggtttgtgccattcgtttttctgaaggatagtatatgaccctaccagagccaccgcccaatcagaaatagctcccccaaaatcagaaactaaaaactggctctttccatctcaccctctgattcacacgtctgtttccctgtctcctatgtcgccctcgctctgtttcctttgctgggacctggggctgctcccagggtcctcgcttaaaataggccttttcacaaaagtgcttattacttgaagcaagtgtataggctagcgtgggtgagaggac

SEQ ID NO: 88329 - DNA, 2290 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaagccatgactacgacagttgtacttgcaccaaaacagcatagaaaaccagagtgtggtgggaggacccgaagccggttgggggaggatgtgagtaggggcctggagggtgcagggtcattaatctgcggggagaacattgtgctttagcccagggaggggaggggtggggcaaatgcaccgaggtccccactttttcctgctgccctcggcaccctggggatgcaggcatctgggcacatctgccccttattgctgcccaccagcgttaaacgcccccgatcccaacactagcaccacaggtggttccggggcagggagaggcaggaatgggaaaattgcttagagaaagattccactagaatccagtgaattgtgctcagttctctttacttcctacaaccgagtacatgggtcacagggtggagggtgcaacaggacatggaacatgcccctccgtgccccccaacacacacctgcacacaggatggtggtgtctgcagcatcacaggtcatgcagggcatggggaaggggaggttcacacacacatagatgcccacagcgggtaccagacggagaacacccctgaatatacatagctgtacatggggaacccccaggtccccaccccaaccctctcccctgtcttgctgtcccccgcaggggaactatattgctttgagagagccaccccaggggctgctctgccaggcaccctcccctcccacccacccccattttggcacatctgcaagacacacagcagcgagagtaggcaccctcccttcccaggcttctgtggcctggagctggagaagggggtaggagacttcatcctccatcctcccctaacccttcccaaacccctgccaaacccactcaagccagaacccacccccaccccccaaacacacatacaaagctgagctatccaggaacacaagggaaacaaggagattgtccagggtgggagcggaggcagcgggggaagaagactggaagcagagacctccccccttgtggggggcagactggcacaacagctactttagtgcaattggagagggtgcccagagtgagaggtggagaagggagggaaggcggtccccaacttccctgggggcaaagtcaggcttccagattccccagggaaagggcctagcaggagtgggtgagggccaaggtggatcctctggttacccgccaccctctgccctcccaaatgcagtgacagtgtccccctcacacctaagtgggcaacagcagccttggagtcagtaccttcaagtaattcaaagagcagaccctccccaccccagcttcaccccatctctgggatttggtcgcttctcctgggaatgggctatcaattgatagccctatcccaggaaggaaaacgatacgaaccagacgatgaggaagtgttccttctcctgggataagcta

SEQ ID NO: 88330 - DNA, 3429 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaagccatgactacgacagttgtacttgcaccaaaacagcatagaaaaccagagtgtgggtgcagggtcattaatctgcggggagaacattgtgctttagcccagggaggggaggggtggggcaaatgcaccgaggtccccactttttcctgctgccctcggcaccctggggatgcaggcatctgggcacatctgccccttattgctgcccaccagcgttaaacgcccccgatcccaacactagcaccacaggtggttccggggcagggagaggcaggaatgggaaaattgcttagagaaagattccactagaatccagtgaattgtgctcagttctctttacttcctacaaccgagtacatgggtcacagggtggagggtgcaacaggacatggaacatgcccctccgtgccccccaacacacacctgcacacaggatggtggtgtctgcagcatcacaggtcatgcagggcatggggaaggggaggttcacacacacatagatgcccacagcgggtaccagacggagaacacccctgaatatacatagctgtacatggggaacccccaggtccccaccccaaccctctcccctgtcttgctgtcccccgcaggggaactatattgctttgagagagccaccccaggggctgctctgccaggcaccctcccctcccacccacccccattttggcacatctgcaagacacacagcagcgagagtaggcaccctcccttcccaggcttctgtggcctggagctggagaagggggtaggagacttcatcctccatcctcccctaacccttcccaaacccctgccaaacccactcaagccagaacccacccccaccccccaaacacacatacaaagctgagctatccaggaacacaagggaaacaaggagattgtccagggtgggagcggaggcagcgggggaagaagactggaagcagagacctccccccttgtggggggcagactggcacaacagctactttagtgcaattggagagggtgcccagagtgagaggtggagaagggagggaaggcggtccccaacttccctgggggcaaagtcaggcttccagattccccagggaaagggcctagcaggagtgggtgagggccaaggtggatcctctggttacccgccaccctctgccctcccaaatgcagtgacagtgtccccctcacacctaagtgggcaacagcagccttggagtcagtaccttcaagtaattcaaagagcagaccctccccaccccagcttcaccccatctctgggatttggtcgcttctctaggggttgggttgggaggagggagcccccaaggcagacccttccctctctacctcccgattcccagaccactgggcttggtcctcaaagattcctcacctccgcccttgcccaacctgggtcaaggctgcagaaggctggagccaccacaattagaggggaaggggctgctttgttccttatccctccttcttaaaaggtagggttcaaactaggcgggatgggggcccatactggtttgccccaggagtagggtttctgggctagggtctgtaaggctattttcctttgcggtgggaaggggaggtaggggatgaacactgggtatgggaagtgggtgagaaatggctgagagggaaggaggaaggggcctccccgctggagcagtcactggagtcatttagacaaaaacactcatgtgcataagatacacagtgcgcaaactcagccctgccagcccggccccaatcccacctctcaggactccttccaagaccctggaggaggttctggggatacagctgtagaaccgttcactctggccccatccaccccacctccagcctcttctccccttctaggtccagggagtaagaaggtgctcgggtgggcagacagtggtggaaacagtattgagttttcctttggttacatattgaaggcaaaggtgagctggacttacagtcaaaacggataggggtgaggaaggaagaggggccatggctggggttggagagggaggtaggccctcctcagcccctccaccccaagaaacacatctacgtggggtggcagtccctcagtcttttctctcccacgccccacagcaccaaacaaaaggagaagccccctcccccaggggctgctccccaccccaacctgggctgtacattcagtggttttcagcagtcctatggctcagggggccacggggcaggggaggtggcccgtcagtctcagtggacagtggcagtgacccgggtctgctggtccttcctgggacccacggtttgtgccattcgtttttctgaaggatagtatatgaccctaccagagccaccgcccaatcagaaatagctcccccaaaatcagaaactaaaaactggctctttccatctcaccctctgattcacacgtctgtttccctgtctcctatgtcgccctcgctctgtttcctttgctgggacctggggctgctcccagggtcctcgcttaaaataggccttttcacaaaagtgcttattacttgaagcaagtgtataggctagcgtgggtgagaggac

SEQ ID NO: 88331 - DNA, 1579 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaagccatgactacgacagttgtacttgcaccaaaacagcatagaaaaccagagtgtggtgggaggacccgaagccggttgggggaggatgtgagtaggggcctggagggtgcagggtcattaatctgcggggagaacattgtgctttagcccagggaggggaggggtggggcaaatgcaccgaggtccccactttttcctgctgccctcggcaccctggggatgcaggcatctgggcacatctgccccttattgctgcccaccagcgttaaacgcccccgatcccaacactagcaccacaggtggttccggggcagggagaggcaggaatgggaaaattgcttagagaaagattccactagaatccagtgaattgtgctcagttctctttacttcctacaaccgagtacatgggtcacagggtggagggtgcaacaggacatggaacatgcccctccgtgccccccaacacacacctgcacacaggatggtggtgtctgcagcatcacaggtcatgcagggcatggggaaggggaggttcacacacacatagatgcccacagcgggtaccagacggagtcaaagagtgggggagccaggcatttagcaatcattttgggacacttggcagaaggggtcgccctgggggtaccaagggcctggggtgctccctgtcagtcccagacccctgccaggccaagatggtgtggcaaaggggtgagcagctgctccccag

SEQ ID NO: 88332 - DNA, 844 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatccca

SEQ ID NO: 88333 - DNA, 3479 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaagccatgactacgacagttgtacttgcaccaaaacagcatagaaaaccagagtgtggtgggaggacccgaagccggttgggggaggatgtgagtaggggcctggagggtgcagggtcattaatctgcggggagaacattgtgctttagcccagggaggggaggggtggggcaaatgcaccgaggtccccactttttcctgctgccctcggcaccctggggatgcaggcatctgggcacatctgccccttattgctgcccaccagcgttaaacgcccccgatcccaacactagcaccacaggtggttccggggcagggagaggcaggaatgggaaaattgcttagagaaagattccactagaatccagtgaattgtgctcagttctctttacttcctacaaccgagtacatgggtcacagggtggagggtgcaacaggacatggaacatgcccctccgtgccccccaacacacacctgcacacaggatggtggtgtctgcagcatcacaggtcatgcagggcatggggaaggggaggttcacacacacatagatgcccacagcgggtaccagacggagaacacccctgaatatacatagctgtacatggggaacccccaggtccccaccccaaccctctcccctgtcttgctgtcccccgcaggggaactatattgctttgagagagccaccccaggggctgctctgccaggcaccctcccctcccacccacccccattttggcacatctgcaagacacacagcagcgagagtaggcaccctcccttcccaggcttctgtggcctggagctggagaagggggtaggagacttcatcctccatcctcccctaacccttcccaaacccctgccaaacccactcaagccagaacccacccccaccccccaaacacacatacaaagctgagctatccaggaacacaagggaaacaaggagattgtccagggtgggagcggaggcagcgggggaagaagactggaagcagagacctccccccttgtggggggcagactggcacaacagctactttagtgcaattggagagggtgcccagagtgagaggtggagaagggagggaaggcggtccccaacttccctgggggcaaagtcaggcttccagattccccagggaaagggcctagcaggagtgggtgagggccaaggtggatcctctggttacccgccaccctctgccctcccaaatgcagtgacagtgtccccctcacacctaagtgggcaacagcagccttggagtcagtaccttcaagtaattcaaagagcagaccctccccaccccagcttcaccccatctctgggatttggtcgcttctctaggggttgggttgggaggagggagcccccaaggcagacccttccctctctacctcccgattcccagaccactgggcttggtcctcaaagattcctcacctccgcccttgcccaacctgggtcaaggctgcagaaggctggagccaccacaattagaggggaaggggctgctttgttccttatccctccttcttaaaaggtagggttcaaactaggcgggatgggggcccatactggtttgccccaggagtagggtttctgggctagggtctgtaaggctattttcctttgcggtgggaaggggaggtaggggatgaacactgggtatgggaagtgggtgagaaatggctgagagggaaggaggaaggggcctccccgctggagcagtcactggagtcatttagacaaaaacactcatgtgcataagatacacagtgcgcaaactcagccctgccagcccggccccaatcccacctctcaggactccttccaagaccctggaggaggttctggggatacagctgtagaaccgttcactctggccccatccaccccacctccagcctcttctccccttctaggtccagggagtaagaaggtgctcgggtgggcagacagtggtggaaacagtattgagttttcctttggttacatattgaaggcaaaggtgagctggacttacagtcaaaacggataggggtgaggaaggaagaggggccatggctggggttggagagggaggtaggccctcctcagcccctccaccccaagaaacacatctacgtggggtggcagtccctcagtcttttctctcccacgccccacagcaccaaacaaaaggagaagccccctcccccaggggctgctccccaccccaacctgggctgtacattcagtggttttcagcagtcctatggctcagggggccacggggcaggggaggtggcccgtcagtctcagtggacagtggcagtgacccgggtctgctggtccttcctgggacccacggtttgtgccattcgtttttctgaaggatagtatatgaccctaccagagccaccgcccaatcagaaatagctcccccaaaatcagaaactaaaaactggctctttccatctcaccctctgattcacacgtctgtttccctgtctcctatgtcgccctcgctctgtttcctttgctgggacctggggctgctcccagggtcctcgcttaaaataggccttttcacaaaagtgcttattacttgaagcaagtgtataggctagcgtgggtgagaggac

SEQ ID NO: 88334 - DNA, 2770 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaagccatgactacgacagttgtacttgcaccaaaacagcatagaaaaccagagtgtggtgggaggacccgaagccggttgggggaggatgtgagtaggggcctggagggtgcagggtcattaatctgcggggagaacattgtgctttagcccagggaggggaggggtggggcaaatgcaccgaggtccccactttttcctgctgccctcggcaccctggggatgcaggcatctgggcacatctgccccttattgctgcccaccagcgttaaacgcccccgatcccaacactagcaccacaggtggttccggggcagggagaggcaggaatgggaaaattgcttagagaaagattccactagaatccagtgaattgtgctcagttctctttacttcctacaaccgagtacatgggtcacagggtggagggtgcaacaggacatggaacatgcccctccgtgccccccaacacacacctgcacacaggatggtggtgtctgcagcatcacaggtcatgcagtgacagtgtccccctcacacctaagtgggcaacagcagccttggagtcagtaccttcaagtaattcaaagagcagaccctccccaccccagcttcaccccatctctgggatttggtcgcttctctaggggttgggttgggaggagggagcccccaaggcagacccttccctctctacctcccgattcccagaccactgggcttggtcctcaaagattcctcacctccgcccttgcccaacctgggtcaaggctgcagaaggctggagccaccacaattagaggggaaggggctgctttgttccttatccctccttcttaaaaggtagggttcaaactaggcgggatgggggcccatactggtttgccccaggagtagggtttctgggctagggtctgtaaggctattttcctttgcggtgggaaggggaggtaggggatgaacactgggtatgggaagtgggtgagaaatggctgagagggaaggaggaaggggcctccccgctggagcagtcactggagtcatttagacaaaaacactcatgtgcataagatacacagtgcgcaaactcagccctgccagcccggccccaatcccacctctcaggactccttccaagaccctggaggaggttctggggatacagctgtagaaccgttcactctggccccatccaccccacctccagcctcttctccccttctaggtccagggagtaagaaggtgctcgggtgggcagacagtggtggaaacagtattgagttttcctttggttacatattgaaggcaaaggtgagctggacttacagtcaaaacggataggggtgaggaaggaagaggggccatggctggggttggagagggaggtaggccctcctcagcccctccaccccaagaaacacatctacgtggggtggcagtccctcagtcttttctctcccacgccccacagcaccaaacaaaaggagaagccccctcccccaggggctgctccccaccccaacctgggctgtacattcagtggttttcagcagtcctatggctcagggggccacggggcaggggaggtggcccgtcagtctcagtggacagtggcagtgacccgggtctgctggtccttcctgggacccacggtttgtgccattcgtttttctgaaggatagtatatgaccctaccagagccaccgcccaatcagaaatagctcccccaaaatcagaaactaaaaactggctctttccatctcaccctctgattcacacgtctgtttccctgtctcctatgtcgccctcgctctgtttcctttgctgggacctggggctgctcccagggtcctcgcttaaaataggccttttcacaaaagtgcttattacttgaagcaagtgtataggctagcgtgggtgagaggac

SEQ ID NO: 88335 - DNA, 2026 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaagccatgactacgacagttgtacttgcaccaaaacagcatagaaaaccagagtgtggggaaggggctgctttgttccttatccctccttcttaaaaggtagggttcaaactaggcgggatgggggcccatactggtttgccccaggagtagggtttctgggctagggtctgtaaggctattttcctttgcggtgggaaggggaggtaggggatgaacactgggtatgggaagtgggtgagaaatggctgagagggaaggaggaaggggcctccccgctggagcagtcactggagtcatttagacaaaaacactcatgtgcataagatacacagtgcgcaaactcagccctgccagcccggccccaatcccacctctcaggactccttccaagaccctggaggaggttctggggatacagctgtagaaccgttcactctggccccatccaccccacctccagcctcttctccccttctaggtccagggagtaagaaggtgctcgggtgggcagacagtggtggaaacagtattgagttttcctttggttacatattgaaggcaaaggtgagctggacttacagtcaaaacggataggggtgaggaaggaagaggggccatggctggggttggagagggaggtaggccctcctcagcccctccaccccaagaaacacatctacgtggggtggcagtccctcagtcttttctctcccacgccccacagcaccaaacaaaaggagaagccccctcccccaggggctgctccccaccccaacctgggctgtacattcagtggttttcagcagtcctatggctcagggggccacggggcaggggaggtggcccgtcagtctcagtggacagtggcagtgacccgggtctgctggtccttcctgggacccacggtttgtgccattcgtttttctgaaggatagtatatgaccctaccagagccaccgcccaatcagaaatagctcccccaaaatcagaaactaaaaactggctctttccatctcaccctctgattcacacgtctgtttccctgtctcctatgtcgccctcgctctgtttcctttgctgggacctggggctgctcccagggtcctcgcttaaaataggccttttcacaaaagtgcttattacttgaagcaagtgtataggctagcgtgggtgagaggac

SEQ ID NO: 88336 - DNA, 1091 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatggtgagagatgtcgggtagagcagagaaatcaagggcagtggggaggcgggagtggagagggaggtagcagtccctccgcctctaccattagctcctggaagggcgtcagaccataggcccgcaaaagtctgagaaacaagggactaaggtgtttgggtgggggctgctgatgctttctgacaccattcctctggagttgagaggtcaggggcaaggccagaatcctgacatcctctttttctttcagctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatccca

SEQ ID NO: 88337 - DNA, 653 bp, Homo sapiens
agaggaccgtcgaccgcacgctagtcaccaggagggatgccctcctatttcagagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactggctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatccca

SEQ ID NO: 88338 - DNA, 889 bp, Homo sapiens
taacatgctctggaatactgtgttccagaatgtgtatataaatggaatatagcacatggccctataaaagaaagaaactattaagaaaatggtccctttagccaattagaggaaatataatttctgacacagggccgctatggccagctggatactgatgcataaagatacctaaccgtttgtagcagagcaggaggtgggacccagagtgtgagccctgagatgatctagaaattcctgtgcaaatggatccatcaacgaagggtgatttcatccattaaggaaaaccaagctgtttgtgaagaaaatttgacaactgttcgacggcgcttttccctcctttaggaagtagggaacactgagtaaatgggaatgtaggaaatactagcatgtgatatttatcagaataagaccagaaatgtctttgtaaacttcatgactctcagataccatgaagcataatgtgtaagtttcacttccagctgccagtaatgttatgtttagagacagcattttcttcaataagcaattcagcaaagttgaagatttaaataaaggaaaaaaataatgcagactacattataaagtaataatagcaggtaatagtcactgagtgcttcttctatgctaattactttacatttattatcccattcaagtttgcatgacaatcagacaagaagcagattagaaaagagaaagcattctgtagcaaaccattcattgtgagtaacaaagtgctatgtatggtgttagagagcctgggctttgaatttacaaagacctgctgaagtccagcaaacaccactactagctgtaatgtagggaagctaccttttctgctcaccacattgatcaactactatagtcaaagcactacactcagact

SEQ ID NO: 88339 - DNA, 322 bp, Homo sapiens
ctctacaaaaacaaagaaaataaagtcataaatacttaagtaaaggcaaatccttgcatactctacatactttttttagaaattagacgattttaactgatgcataggaaatatctaatctcatggcttcaaataatggaattaaatttctgtctcaagtgagagatattttccccataattacacaggtatagtacacactgaaatccagctgggccatccactacattctcaaactgttggacccattgaataatggcctgttgcaattggtactaaagacacacaaacacaaaaaaagagcatttacgtaaagcagatt

SEQ ID NO: 88340 - DNA, 207 bp, Homo sapiens
tccactattcaactcagtagagcattcataaatgccttgtggaaactctgaagccacccaacaacacactttgaggttatcttgattgctctaggggaagccagctggcatgggaagtagtgcagtggagaaatgcacatggccagagactaagaccaatcatttgaatgagtttggaagcatcctacccaccactgccaccagtca

SEQ ID NO: 88341 - DNA, 730 bp, Homo sapiens
cttagagtgatctgccactgactcattgaacaagtcttatgttgttacgccttttgtattttctcaagttgttccctcttgctgaaattcccttctctccatatttacttattgaggtcatattcatttctcaagacccattttatgtctcatctcttctgggaaatcttcctcagtactcagtcaaaatctgtctctcaaccctgtgtttccataagactttgcacgtacagcatttatcacagtataccttgtacttatacggagttattttacctactgtgtaagtgctaatctatcagctagagcaagaggttggcaaattatggtctgcaggcaaaacctggcccactgcctgttttgtaaatagtgtcttatgggaacacagccacgtctatttgatgacacattgtttaaggctgcctttgcgctgtaacagcagagttgagtagtgatgacagggacaaatggtcctcaaagcctaaaatatttaccatctggttctttagagtttgctagcctctgaactaaaatgtgtggtgtattgtgtcctaattatgtactagcacttaatagaatgttttgtagagagttggtactcttataagttatataaagtaattggtgaaaggatgaagaatgagttggaaatatatgtttattatgccaacagggtaaatataaactctttttctattcctgccttagttggtttttaagtccgtgtccc

SEQ ID NO: 88342 - DNA, 232 bp, Homo sapiens
tgactgaatttaatcctgataggcacagctttaattgattttaaatatatgctctggttccttttaaaatatataccaaattttcaatttttgcagaaacatcctttaatcagcctgggtggtggctaacgcctgtaatcccagcactttgggaggccaaggcagaattgcttctacgcaggtgttagagaccagcctaggcaacatagggagacctcgtctctacaaattt

SEQ ID NO: 88343 - DNA, 504 bp, Homo sapiens
ttcctgtgccctctgcttcggcaggtgcccttcctggctccctgcttcttcctctcctaacctcctggcactgtgctcctcactcaggaattgcacccagcatcacctctgcaggtgagtcccacaccttccccctgctctccaaactcagaccccaagtccagcagcatcttctctcaggcatctatagacctccacaacttaagacatccaaattctcattcccttgccttgccataatcttcccatctcagcagctccttccttccaggctctcaggctgaaggtggcctatcctttcttttctatcccacatggcagccaggaggcctgtgggcggtgccttcaggacatgcctcttgtgcccctgtcccctactctggcctgagtgttccttttaaaactaggtcagaactagattaaagcccgtgtccaagatgctgccacagtctcttgccaccatatgactgccatgtcctcactgtggcccaggaggtcccatgt

SEQ ID NO: 88344 - DNA, 183 bp, Homo sapiens
gagatggcagcagtacagtccagcttcggctcagcatgagagggagaccgtggaaagagagggagagggagaccgtggggagagagagggagagggagagggagagcgcttaaaacaatttttaagatgtatttcttttctcatagttccagaggccagaagtcccaagtcaagggttggaag

SEQ ID NO: 88345 - DNA, 864 bp, Homo sapiens
atctgtggtcccagctactcaggagcgtgaggcaggagaattgcttgagcccaggaggtcgaggctgcagtgagcctgatggtgccactgcactccatctggggcaacagagcgagaccctgtctcaacaaaaaagagactcataaagctgtagggggttgggggggggcattggcacaggtgtagaaaatgaagcctgagggtcccctgacttgtccgaggtcccccagcttgggatccttttcaggaggagcccagcagcccctctttccctggtcctcctccctggagccgaaggtcagaggatggtcctggggcccaggcagccctgtgtggcttcctgggggtgtgcatcagccctgtccctccccaagaaggcgggcatgtgctggagggcaggcatgtctgagggccctgtctccatagcacgaaggtggagcaggttcgggcccacctgggcactgcgtccctcctgggcctgggcgggagcccggtgaagatcgggctgcggcgggtagtgctgcaccccctctacaaccctggcatcctggacttcgacctggctgtcctggagctggccagccccctggccttcaacaaatacatccagcctgtctgcctgcccctggccatccagaagttccctgtgggccggaagtgcatgatctccggatggggaaatacgcaggaaggaaatgccaccaagcccgagctcctgcagaaggcgtccgtgggcatcatagaccagaaaacctgtagtgtgctctacaacttctccctcacagaccgcatgatctgcgcaggcttcctggaaggcaaagtcgactcctgccagggtgactctgggggccccctggctgcgag

SEQ ID NO: 88346 - DNA, 102 bp, Homo sapiens
gatctatgtctttcagctatgtgcttttaaaactttgtaatttagacattgatattgtcatcagattgcttatcagcattgccataaatataattattaatg

SEQ ID NO: 88347 - DNA, 460 bp, Homo sapiens
ctatcagatcagcgttcacctggtcccgaaccccgcctagcgaggggtcgtgagggagagcgagctgggggtacaggagtatcatttcctgcggagattcgtgttcttcaacattttttttttctgaacttggaaaacttttaaggacgaattagagaacttctttctctttcctatgagtaactcgaactttggtaatacagttgtggatcatagattacatggattaattccagggttatgaaattcaagggtggacactcatttgttcctattggacatgctacccaagttgcattttaaaaatgtattttaaaaacccaataaatatttaaagaagaaataatatcaattcttcacaaactcttccaaaaaatagaagagtaaggatgatctcccaactcatgctatgaggccagtatcaccctgataacaaaaccagataaagacatcacgagac

SEQ ID NO: 88348 - DNA, 749 bp, Homo sapiens
gaaaaacatataatgacatgtatccacacatagagtatcatatagaatagtttcacatactataatttctgcatttaggaaatttacccttactataatacaagtatccgctatgctgcccataattggattttacctgtggcttctataatgtcccagaatttgcattgcatttaatcatgtctctctagtctcctttaatctgaacggttcctcagccttttgtctctcctgacatccacatatttggatagtccaagtctgttttttcatagaatgcctcctcattcctccctcacacattcgttctttactttgctggggagcatgtttgaaagtacagttcacattctccaattttatgtctgcagaattccaccctcctcagaatcttgactaaaaggccaaatgttattgtcttagatttaaatcatggacttgggccgggcgtggtggctcacgcctgtaatctcagcactttgggaggctgaggcgggcagatcacaaggtcaggagtttgagaccagcctgaccaacatggcgaaaccccatctctactaaaaatacaaaaaaaaattagccaggcgtggtagcatgcacctgtaatcccagctactcaggaggctgaggcaggagaattgcttgaacccaggaggcagaggttttagtgagccgagattgtaccattgcactccagtgtgggcaacagagcaagactctgtctcaaaaatttaaaaaaaaaaaataaa

SEQ ID NO: 88349 - DNA, 575 bp, Homo sapiens
  misc_feature (556)..(556): n is a, c, g, or t
cagtgttactgctctacctacatgtgcacacaaactctgtttgtgttgaggttgagtactgttctttaaaatcattgttgaatgacaattagcaaaaacaagagccctcacatgtcctcgtggtggtatgctggcaccacgatttctccaagcccccggcttgctcatttcatccaggtgaggagtctggagtagagcagggcttctgaaatggtgacatgcacatcactctcctgggcatctggttaacatgcaggctccagttccccaggtctgggcggggctcaagatcgcatttctcataagctcccaggggatgctgctgctggtggtctctggaccacactctgaggagcgagggttggatgcgttatttcatcctcctgaccaccctgtgaagtaagtattctcagcctcattttatagatgaggaaacgcacccagctcaacctaacacaggtggcagggttggaacccaacgttggttctaaccggcctctataaaaactttatactgcctcccattttcttctggggcttggaaggtagcccttanacgcgggatcctctagatc

SEQ ID NO: 88350 - DNA, 278 bp, Homo sapiens
  misc_feature (3)..(3): n is a, c, g, or t
  misc_feature (128)..(128): n is a, c, g, or t
  misc_feature (270)..(270): n is a, c, g, or t
  misc_feature (273)..(273): n is a, c, g, or t
  misc_feature (275)..(275): n is a, c, g, or t
  misc_feature (277)..(277): n is a, c, g, or t
agngaaggacacaaggaaacttcttctagggcccctgtgctcactcagaggtctttctgggatggggccctgggctcccagtggcataggagatcccactctctgctggacgctccattttagaaagncacacccaggcaaggaggcaggcctagggccacagaggggacacccctggaggccagcctcagggcaccagaagacagagcagaagagaacagggaagcagaggctccgccctagggggaggtcatgcggacaccaggcttntangngnt

SEQ ID NO: 88351 - DNA, 397 bp, Homo sapiens
taaaaacaaatgcagtaatacgtattaatataaaattttaaatacagttgttacagaaacagtgttagtaggaatcgctacaggtttatactggttaagggaaaagtaaagattgttagaaaatcgatacagaaacagcaaatgaagtgtgggaaaattaaaggagaaataagttaataaaagataaaataatttaaaaagctaaaaagatatatttggatcatgtgaagaattctaggtgaagatgctattctgtggtaaaattattttggtaaggcgtgttaagtttttgagatattaggtatttacacaataaaattattatttaaaatagagtttggagctaggcctggcggcacacgcctgtgctcctagctacttggtagattgaggtggg

SEQ ID NO: 88352 - DNA, 351 bp, Homo sapiens
tccatccttcctgtcctccctaccacttcccatgtggctcattcctggaagataccatctctctaaacccctgtctccctgtatccctgtgggttgtttctggaagataccatccttccacaccatctgcccttcttgtctccccagccaccgcacctgtggccctctccaaagccaatccaccctgtctcccccttctcctgtaggtcattcctagaagacaccatcccctaacaccacccacctttcctgcctcccccagtcaccatgacaacccatctccctggaccagggttcaggatgcgtctccaaggggctgtgcacgggaaaggtgcctcttgggggtggatg

SEQ ID NO: 88353 - DNA, 201 bp, Homo sapiens
ccacctgcctcggcctcccaaagtgttgggattgcaggcgtgagccaccgctcctggctcctgctgtatactttaaattttctttagattgcttatacctaatactatgtgaatgttgtgtaaatagttgttgtactatattgtttagtacagatgcaaccatccatttattcccgtctaatatttttcttcctcggttga

SEQ ID NO: 88354 - DNA, 429 bp, Homo sapiens
ctttctgaggaccctgaccactctgttctgttcactgcctgacaaactataggcacttggatattttgtaaataaatagtgagtaaataaattcctcaagacagagttgttttgtcctccttaaaaattatacctttagaaagctaaaccagttattatactttaaactggcattaagttaaggccttctgctcaggaagttcaaggccattatatgttattctatatttctagtttctacttctaggttgaaaaaaatgagccacatatggttagctaaactcatttctaaaaacttggcatgttctcaaaccatattcaaagcttatgtcagttttgaagacacaaataaaatatattttccagaacttctcctcctctggttgaatttttggaaaagatctcccacgatgtgaacttctgtaaact

SEQ ID NO: 88355 - DNA, 708 bp, Homo sapiens
gcccctaggcggctgctggccggctctgaatcttgaatcacatggttaagtgattattggtggggaaagcttaaagacctgtagaagaggaggaggggggcatgtccaaggtctcgaagtcagtttgggcagagcttggactcaaacctggggttctgactccaagcccagctttccttctgtcagtgggcctaaaaatagaagactgaccttttcttggtatttttgtgcttcacaaatgccagagcgttattcattagttcatcttcccaaaataactggcagaacacggccagagggcaacaggaagactctgggctgcgccccccgaccgtgaaactgggggctcctgggaagtgggggatgtgtctcaccatgggcatagtttccccccactgttggagtggcctgcctggccctgctcttggtgagtccaggggagagagcttcagagggcagaacagatctcaggaggatgttaggatcgggagcttgagtctatccagttcccaggcagtttgtgttccctccatcatcctcccttttttttctctttttggtttaaaataaggtttacaataggagtcttggaaaattcagacaagcacaaaaaataacaaaactcactgcagtacaactacctgcttctctcactgtgtcagcttcaaatctccagctgccttctctgctctggacaagggggaaaga

SEQ ID NO: 88356 - DNA, 281 bp, Homo sapiens
gggttatgcatgagacacttggcttccacccacctatggaatttaatttatgcctggttggtttgattttttttttccctcaatcaccctcctttaacaaaggccagtcaatgagctgagttttgctgtcttctgctattaggaccattttcttaaggtagcaatccatagaccatcacaatgaagtgtgtttgtgtctatgagtgtgtacctgtgtgtgacattctttcttttctttacagtattttatgtttagcttgatctgtaataaattaaagtgg

SEQ ID NO: 88357 - DNA, 144 bp, Homo sapiens
tgattctataacattatcctggatgcactgtagcttttcatagcctgctgcaatgaatcatgtattatactattcacttattgtttggcaaggagtgagtatgggagaatggtgtgttttatagataatagtggcgtttgtttt

SEQ ID NO: 88358 - DNA, 542 bp, Homo sapiens
  misc_feature (435)..(435): n is a, c, g, or t
tttaattgtggggacatacaaatttaggtgataaggattttagaggagacagaaatcagagcccaagctgttgggggaggggatggtagtggagatgggagattggttacatacaggggattgataaatatattggtagtaatgggagccatgcttcttactgggagccatgcttcttactgttaggaagagggagctgaaggaaaagatgattacctttatacatgtttgaatgatactgtttttacttgttacaaagagcatatattctgttgtaatttgaaaaatgatcatatggaaaaatattttcagaaaaatggcaatttcaatggaaaaatatgaaaaaaaaagttttgatgaaatattgaagttcagaaatgacagaacagcatagtggtctggggaaagaatgtcaaagttcagggctgaatgtgngtgtcacgcctgtaatcccagtactttgggaggtgaaggtgagaggattgcttgaggccaggagttccaaaccagcctgggcaacatggcaatacttcatctctgca

SEQ ID NO: 88359 - DNA, 298 bp, Homo sapiens
cattatgctgttgttctggatggcaggagcatcacagagaaagacaaaaggtgactaattaagttggactccagaacagtaaagggtcttgtttcttttaaaagaaatatcaatactgattaaaagttaagatgagatctcaaggatgacaattagttgctaatccttcaagatctaacaaagtatctagatggaaaaatgaaatgtttaacaatgaccagaataataaaaatagaaatgggaaaataatgaatagcagtgagagaaagaaacacatggtaaataatgacaaagaaca

SEQ ID NO: 88360 - DNA, 237 bp, Homo sapiens
gttaaatgacttgcccagtattactcattagtaggtgttacacccaggactcaaagccagattttgtgtggttatcactgatactacttcagggtactcagaaacagaactggacacacagagtgaagcctttcactctgccctgatccttgggctctggatccctataccccaaaccccagccctctggtctgtggtgttactgtgatgtgaaagaggattgccttgggactgcct

SEQ ID NO: 88361 - DNA, 250 bp, Homo sapiens
acatgtgtttctatttttttactgtagtctaaaacaaaacaccacattactgacatccttgatcaacaaaatattagaataatagagatttttcaattcatcattcatgcaccaaacctgccctgctttctgtgtgtcaagccttgaacaagaaaccacggcacagaaatgaatgttcacataaggcacgtccctgcccttcagcactgccagaatattgagccccatatttctatgaagcaaccaagga

SEQ ID NO: 88362 - DNA, 396 bp, Homo sapiens
ttacagacgtgagccaccgcgcctggcctggtctcaatctcttgacctcgtgatccacctgccttgcccccgcaaagtgctgcaatgacaagtgtgagcgaccgtgcccagccgtattaagtgacctttaacatcctttccaaacttgggcttctgttttatgcgttaataaattctgttgtgcttttctagagaaagcgattttggtattttcttctatagtaataattggggaatttttccttatgtatagccacataagaagtagagaatactattcaattcattgaatatgactaaattacctgttaatctttccttattttgattccatagcttttgaaaagctcagagatcaagattggactacttgtgaatattttttatttcataatc

SEQ ID NO: 88363 - DNA, 502 bp, Homo sapiens
acttgtattatttacttctctgtccccaggcaggaccttgatccaaaaatgctttgctgttgtttttggccttaatctgccagaaactagagggagcagatggccacagcaatgtgggttatgaggatgtgatatcaggcagggttgaaggatgaattgagagccctgcacccaactacttctgtgtctgtgcctaggcccttgtcagggtagtctctatctgagagtgtagctggtcagcctggtcccatttctcatttccagtcacctccccctcttgccatcccatataatggggttagtctcctggacagatctcatacagaggctgctgggatctgctgtccaaatgaccctttggacctatttcccagccatgttccaagatgatggtgaggagtctagccccacagccagtatgctatctctattcagataactcccagctcacaggcctcccaccaggctctcacccactctgatgttttcactcctgactcct

SEQ ID NO: 88364 - DNA, 367 bp, Homo sapiens
gcaaataaacacacttaatctgcccctttgagataatagggtaagttcttaacagtgattcaaaaagtaactacctttcagaacaacaacaaaaaatttaatgctgtagggaaaggatattgaaaatggatatttagaatttttcctgttatggaatttaattgttgaaaattatatgtgttaactttaagagctttttttatatgtatacttgaacttggaaacagaattttctaacctgtataaaaatcttttaaaagagctgtttagtgattttgagcccatctgctgaaaacacaaaaaggcaataccatctgattagtttataagaacaactgattgccatcagaaggtatggaaatgcact

SEQ ID NO: 88365 - DNA, 321 bp, Homo sapiens
atgtggctgctacgtgtcagatccattgaccctaaaccagagtctgaatcaaagaccagggctctcacaatcttccatgctgcattacctttctagggcttctgtttgctacaattttatggcccattaataagcagaaatttatattcagcaatggatatacaattaattgagtaacatagtataaatattgcccagggaagtatttataggacaatattttagaagctttcatatctatagttatctaactctgccagggcaaagccgatcgttctgacagacctggcttggcttacctagaactgtgaaaatggaaag

SEQ ID NO: 88366 - DNA, 400 bp, Homo sapiens
ggggaaaccttgaaaactttacaaatacatagaaattaaacaacatgctcctaaacaatgagttaatgaataaatttaaagagaaatttaaaaatatcctgagacaaatgaaaacggaaacataacataccaaatcctatgggatagagcaaaaacaattctaagagggaagtttatagcaataaatgccaactctcaaaaataacccaaagcccaaactttgagaatgatctattaaatgcaaataccctgagaaaggatatcccttttattaaacattaattaatattttatgagaaacttgttttgttgttgttttgttttgaacagatggctcttcctctgttgcccagactggtgtgcagtggcacaatcatagctcactacagcctcaaactcg

SEQ ID NO: 88367 - DNA, 535 bp, Homo sapiens
cctttgattatctttcttagagaatcttatccagcccctatgacacaattgcctgctgtatgcatgtggggagatgaatcacatggtcatctcaactcattgcagttggtagtggttatttttggtagggattggaggccgacatgtcatcttcccagttctttttcacttttatctttcccagaaagtgtgcccttatgctttgagtggcaaaattatataccacacattctgatagatctggttctgggtaggaaattaatttgatctctgttgaaattgattttactgtcagagtctgctattgaagagggggattatatatagttagtgcttcataggaagacctgtactcataatactgctgaaagatctgtgatacttacaggtttcttaaaatcagaacagttgtctcaaaaataagaaaataggtaattttcacttgacttttatgacaaagtaattgtatagttatttaaaaacgactttagatttttctgagccagcagtccgaatttcagataatgtattcaag

SEQ ID NO: 88368 - DNA, 270 bp, Homo sapiens
aaaagccagagggatgagaatgagaaagttaaaagggaggtcaggaaagccatcttttaggagaaatataaattgacaatgctttaaaaaaggagctgccatcatattataccctgacccagctggatacgaacaaattcagccttggcaatgcaagtcttacatctattttatatagaatgtataaaagagaactggaagcattttcaagaggggtatgtatgtgtttgtgtgtgtctggtaattaatgaaagagaggctattgaattt

SEQ ID NO: 88369 - DNA, 452 bp, Homo sapiens
aggacttagtcaaaatacttaatgtcttagagtttttcatttatctatgaaataagacagttacactagatacaaggtttttctaacttgattattctctaattctatggatatgacagggtcttagccatcaagtttacactaagaaggggaaataggacatgcattaaacaatgacacaaattactgagaaatatactcagaaattcagagctacaaataaagtactactgccatgcaagttcaaaggaataaaagcttattttggttggaacaatcagggagcccttcataaagacagtggcatttgaattaggacttgaagcatggacgaggacagagaccagttcagacaaaagagagagaagcataaaagcagacaaagcagagtagacaaaggcttaggaagggaagcgtaagacaggtcctaggagcaataagtcacccagaat

SEQ ID NO: 88370 - DNA, 270 bp, Homo sapiens
gagagagaaactttcaagatttggactcttaagaaatttactgctccttaacaacaataaagtgagaaaagagaagctgtctctttcctctggggctggagatgattatgaaagacatgcatggtctttcctgctgattgttacagagtgccagccccccaccccacaccagaactcgaggtctgcctgctcaacaacaacgaacatgccatgcagacagatacgtgagcaaaaggaacaataattaaagaacagtaacaaaaacctcct

SEQ ID NO: 88371 - DNA, 386 bp, Homo sapiens
gactatgtctccttcaaagtagtgtgatgagctctgttagcatttgaacctgtcttcacattttcttctgatttgtggacacttacgaccttgctatcctgtgttctcaagtttgggtatattctgacctcaggctcgttttcacctgtgtatagagcatctagtagttctcaagggattgtattgcccctctcctgcccttggggcagttggggtgtggggtcttttattgacaagcaagggcattcctgacatttagtgggtatggctggggttaccaaagtcctgtgaaagacagggcagcctttcttaccacgttgttaaccttacccctgatatcaaggaaccctgatagagcaagtctgatttgttgggtcattttacaa

SEQ ID NO: 88372 - DNA, 579 bp, Homo sapiens
caacgatggtcctcagctcattcaggggcccccgggcttcttgaatgagctgagaaatagtgtggttagatagagaaaggtgggctttctgaccagaaacactcatgttgccttttcttcaatagacttctgtcttctagtgcaggtgacatgcgctgtactagacacttcagcagggctccagggtgtaggaggtcaactattttgacaaccacagtctagtagaggagataagtaaatatggaacattagtacggtgtgggtttggtacaacaagcggcattgtggaacactgtggcaaggacaatgaattcttctaggagagttggggtaggagtaatccaaagatttttctagaataaagaaaacttcaacctgggcaacataacaagaccccacctctacagaagatttaaaaattagccaggtgcagtgtggttcgcctgtagtccaagctatttgggaagctgaggcaggagaattacttgagcccaggggtttgaggctgcagtgagctctgatcacaccactgcactccagcctggaagacagagtgagactgtctcaagaaaaaaaaaa

SEQ ID NO: 88373 - DNA, 2851 bp, Homo sapiens
tgacgcgataggacagaggccaagctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgaaaaaaaaaaaaaaaagttttgccctatag

SEQ ID NO: 88374 - DNA, 2151 bp, Homo sapiens
acaacaagtgaagacaggctggaagtgtctttctagtggcctcctgactgctccagttttgtccagtcgagatgagaaaggcaggcaccatgcccaaggtgggtctcgaggacatttcaccacatagcattaatctggggtgctttggtgccctcatgggctctaggtgctgcttgtcacccctggctgagtcttgttgactttcttccctttgctgccactctcagcatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgaaaaaaaaaaaaaaaagttttgccctatag

SEQ ID NO: 88375 - DNA, 1908 bp, Homo sapiens
atgtcactgagtggcctgaaccaaagctcatggatactggagatgaagaaccagcaggagaccccaggtgtgctctcatccgtactctgtgacaccccttagtggactgttccaaccagttgggcccgggagaaggactagggaagcttccttcccatctgcacctcccagcctggagaggagcctgtgacttgccctgttccttggctcctcaggctggggtaaggtgtgggggtggctccagccttgaggccagtctcctgatgctggattccttgttttccctgcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgaaaaaaaaaaaaaaaagttttgccctatag

SEQ ID NO: 88376 - DNA, 778 bp, Homo sapiens
tactactactaaattcgcgggtggtggacctcgggaggctgaggcaggagaattgcttaaacctgggaggtggaggctgcagtgagccaagatcgtgccactgcactccagcctgagtgacagagcaagactccgtcaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgaaaaaaaaaaaaaaaagttttgccctatag

SEQ ID NO: 88377 - DNA, 1316 bp, Homo sapiens
tgacgcgataggacagaggccaagctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccgtgagccactgtgcccaccctggtatgttttttttaaattggcacttaagagttgtccttcagaaagtggagcagcagtgtgattagtaaaaacgatgggctttctgagctctggttatggtcttggtgttccagttaacagctgttactttcatgctgtatacgggggtggggcgagaaacgagaaagatatgttagggtaaattggggctcaattgttataagttttcctgaagagtacccagctgtcggccatgttttaagggtagcattggagtgcatttggtatggggggccacgggggggatggttgaaagggctgtccagggttacccttggagaggaaagggggttctctgaagggg

SEQ ID NO: 88378 - DNA, 902 bp, Homo sapiens
tgacgcgataggacagaggccaagctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatccatggttatctgggtattggggaatggaaactttgggggagtgactttttaaagagacacttataatttctactactgcactactgtccattgtgggatgattaaacatggtatttaactgtgaaaaaaaaaaaaaaaagttttgccctatag

SEQ ID NO: 88379 - DNA, 407 bp, Homo sapiens
ccatggcttccagaacatgtgtcccaattggttcctctcctttcccacctggactggctgcttttgacctctaactctttgtcttccagaaaacaataagcctcctcaggcagatgcaggcccagataaagagctgacccttcctgtggatagcacaaccctggatggcagcaagagctcagatgatcagaaaattatctcatatctctgggaaaaaacacagtgagtattgacacaaaatccttatttttgcaaagcctccagaccttggaagagcaaggttttatttgctattatgagttgagttgctcttattggcttatccagtggggtgactgaggaagaaatgtttgcaattccaaacttcaactccaagaaaatgatattataatcataatttttgtaag

SEQ ID NO: 88380 - DNA, 458 bp, Homo sapiens
tgactgatccacatgctttccagatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagaggtagctgggcaatgaatggggggagcaaaggaaagaccaggggcccccgggcttcttgaatgagctgagaaatagtgtggttagatagagaaaggtgggctttctgaccagaaacactcatgttgccttttcttcaatagacttctgtcttctagtgcaggtgacatgcgctgtactagacacttcagcagggctccagggtgtaggaggtcaactattttgacaaccacagtctagtagaggagataagtaaatatggaacattagtacggtgt

SEQ ID NO: 88381 - DNA, 2374 bp, Homo sapiens
  misc_feature (2363)..(2363): n is a, c, g, or t
tgacgcgataggacagaggccaagctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaagaaatgatatctggcccccccttaacactggagccccactcccttctcccatccggcccgagattagggaggattgactgtgtcagggatggcgggtggcctctctcgcagggagcactaaaagaggtgggagntctaaagtcaa

SEQ ID NO: 88382 - DNA, 1719 bp, Homo sapiens
  misc_feature (6)..(6): n is a, c, g, or t
ggagangacaggaggaggagagggacagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgaaaaaaaaaaaaaaaagttttgccctatag

SEQ ID NO: 88383 - DNA, 453 bp, Homo sapiens
cggcccctactactactaaattcgcggcccgtcgatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctggggtcagcaagaaaagatgaaggtatattcctggaatgcatagaccttttagtgggagcgccacacagataaggtcaaatgctttccgttagctctctcattcttcatgattaaatgctcataaaaatgcttaattgagaaaacagaaagaaaaatgtaaaaaataattggcttgcaagccgggctctcccata

SEQ ID NO: 88384 - DNA, 1824 bp, Homo sapiens
cggcccctactactactaaattcgcggcccgtcgatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcatggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtct

SEQ ID NO: 88385 - DNA, 388 bp, Homo sapiens
ctctctgggtctctgtctcccctcctctctctgtgtctctgtcccccctcctctctctgggtctctgtccccaccccgtcccccaggtctttgcacaccctctctgtcacagtgtctcttctgaatctgtgaatgtcactcctcgcagtgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgag

SEQ ID NO: 88386 - DNA, 774 bp, Homo sapiens
agctatttaacctgaaagcgtaggagtctttccattatagaagcccctccgttccaaggaactagcgatggggctaggtcaatcagcagagttgacaacagggcttctttttgtgcaccagcattccccttcagagagcataagatcctgccagtgtgccaagtttgcagctgaccaaacttctaggttgtactggaattattctatgcaacactgatccttatatgaatgcgtttcttctgaatgatgttgactacccttcttacaacaaaactgtttcttttttattgcaaatagggctcttggtgttttttacttttttgtacatatcacagtacatggtttttcactctttagtttatttcattttattggaattaacttttttttattctaatactgacagagtttgtaatctctatataatacgtaattactccaattacagcacttttaccttgaagagcatctcagtttttcccacaatttcattgagtcatcagagactgatgttgcttcttggtttcaaatttggtcctaaagaaactttcggctgtagaaacaaaagcacagagtgaattttttacaaaagacagggaatatagaatagtcattacagacacaaataaccctagtagcacgaagttggtgttttctctgtttttacttaagattaagaagatttttggtgactctgaactctttatttatatttcagtttaaaatatcaagactaaggggcatcagttatctttactctttaatattgcccat

SEQ ID NO: 88387 - DNA, 303 bp, Homo sapiens
attttctcataattttctcgtagttatggaggctggaaagtcttacatcaacatctggcagtgttcagtttcaggtggggctttcttcctggcttgcagacagttgcctgctctctgtgtcttaacctggccagagagagatctctggagtctcttcctcattttctagagggagcagttctattgaatcgggactctacccttccagcctcatttactcttaattacctccctaaaggcccttatctccaacacagtcatgttggggggttatggcttcaacatgtgattttggggaggaca

SEQ ID NO: 88388 - DNA, 353 bp, Homo sapiens
ccaaggggtctcaaggaagctggtggaaatggtaagacggcagctccctttcccgtttcccaaaggtcagggagaaggaacgcacgacagcacatacaccaccatacttttcaccaatgtctacactgccgaccctctgatctgcccttccttagtcttcaagttctcctttataccttgaagatgggggatgagctaagattaggcaaaagtagtttcacaaaatcttagcacttcctgcataggtagtcttgaacctcgctttggactttacagtccctgggcctttggtgcctgttttactgttcttgcttttgattttttttttttttttgcagaagccactaaacaat

SEQ ID NO: 88389 - DNA, 387 bp, Homo sapiens
agttcctggaaattgtagctatcatcatgatgatgatggtgattatgattgttaaagactgggttaggaaatgattttgtaaatacaatgagaagaagagctttaaaatttgcctaaatttccccacttaatattaaaaaggaggtgtgctattaaattttaggtttttctcaaactctcacagctatttttgtgggtttttagtgtatttcgagcccccttttccctcatctctattactttatgataatgtgaaggctcattgttatgtgaacgcactgttatgaaacaatactctcagacataagcagctttccttaaaccaaatcaaaaatactatttctattgcccatgattttcagaggacttcagaggaccctgaagcat

SEQ ID NO: 88390 - DNA, 546 bp, Homo sapiens
  misc_feature (38)..(40): n is a, c, g, or t
  misc_feature (46)..(46): n is a, c, g, or t
  misc_feature (56)..(56): n is a, c, g, or t
ttcgcggagcctggggaagcttttccagtagtactttnnngcgtgntgaccctatntcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagctcc

SEQ ID NO: 88391 - DNA, 493 bp, Homo sapiens
  misc_feature (29)..(29): n is a, c, g, or t
tcaagagtaaagaataaaaacatttattnttaaaaatacccatttagcatcaatgtgccccaagtttgggcaggcatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagctcc

SEQ ID NO: 88392 - DNA, 724 bp, Homo sapiens
aattagcatcttgaactattattattagatagcaataacaaaggtaagtcatttgaaagacacatggagtaaagagataaaaatgggttttaaagaccagaagggaacaatgataaatgagaaataagatagccacaggatgtggccacattcactggaataaaatatgtacgatacaggatcaaaaggcaacaaagaaaataagtagagagaactgatagggcctctattttcattaagttaagaagaaaatattttactaaatcagaagcttaaacttgtagggcaaaagtattttagtatttttactaaaaaggaaaaggagcctgggatactgaattggtcttgattttagaaacagcaagagcacaatgaccaaaaagaaaatgaatagaaagaaaagtatgaagagacgtatttttaaaatgataggttaggctgggtgcggtggctcatgcttataatccaagcactttggaaggccgaggcaggaggatcgcttgatctcaggagttcgagaccaacctgggcaacatagggaaacccccatctctataaaaagtacaaaaattagccaggtgtggtggtatgcagctgtagtcccagctacctgtggggctgaggaaggaggatcgcttgaacctggaaggctgaggctgcagtgagcagagatcgcaccactgcaacaatccagcctgcatgacaaaagtgagaccctgtctca

SEQ ID NO: 88393 - DNA, 1228 bp, Homo sapiens
gctctcccgcgggaaatctcgtccgcacccccaacgcgttcccggagatccggtgggcccccacaatcactgggcgctcacaaggtgccgcaacccgctgccaaaccaaagatgtggggattttaccgcagccacagggaggttaccgccgcgagttctggcgcccccctccccagattcaggtcgcggcaccgcgccaaaaaagccttttctttaaaccgggagccctccaagccaggaaaatggccgatgaggcacatattgtggcctcgccaaaacgggggcttaaaaactttgaggaaaataatgggaaaaattgtggcccccctcgggcgcaaatgggcgagcaccaccccttcaaaatggccaatgcccctctccccggaaaacctggggggaataaacgcccccttcccgggaaaaaggagacacatgtgggcccccttgagaagcctttgggtatatctcgaaaaattcacgccaccttgggaatttgtaaaggaaacctcttggtttggctgagatgtcttgagactcttgttaattgaaaggtttaaactcgtgttccccccctgggtaaatttggttttaaataaacccctggtaacacaaaatactttggagagttgcaaccctccttaaagtgaacgctctgtttggctcttgggtacaacctcttcgtgggctcaaaggtgaaaagaaacctggcctcttgtgggaaaaacacacacgttccttgtgggctctcggtgtgaagtctctcgctgtggggccacaccaagcctctcttgaattctgtgcacagggtgaattaaacctggtacacggggtcgagatgtgtttctcgggaatttttctctctaagagaggctcgggcaaagagaaccacagcttgttttttgttcttgcgggttctgtcacacgggttggagaaagtccacaagccgctaggagacccacgtttcctctttttaagctcgaagttctcttggccagaacaccgtgggctgttacttgccttgagttgagaagcggtttgcatttaacgcctgtaaatgtattcattttttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtataattggaaaaaaagaaa

SEQ ID NO: 88394 - DNA, 722 bp, Homo sapiens
catcccaaaagatgtgttgggcacctcattacaacctcaagagcatggaagtccaggctcctcacttggcctttgatgatgtgggtgtagtcaggctactgacttttctatgttcggatgcaacagaacagttattgtctaaaagtcttctgtcttgctaggttacctctttcttggtcctttgcctggaaaaagtagggttttgttagagtctttttttttttttttggtctgcacccattggtgtttctgagttgccagctttttcagcttcaactccgggatatgtgaaaccaaaaacaatttcccacaactcactgctatattgttcttcaagtcctgaggtctctagccagtccttttctcaatgtcttcttatatttgtttacatacaatgtccagggttttagttgtacttagtgggaagaagagggaaaaatatatctgcttcatcatcccagaagcagaagtcttagttttcattattttaaaatagacaaattagaatgcctttgttaacccaaatccccaaccaatttcttaaaatgtaattaaaacacagtaaaattgctatatataactgacaaattcttatttaagatatgaaatacctaaagcatcaccacaatatcaatcccattgttagtgaacagttgtttggattcagtgactgcctgaggctgggagtggaagatgaaatgaattgcaaagggtcacaagga

SEQ ID NO: 88395 - DNA, 823 bp, Homo sapiens
cttcccaagtagctgagattacagggttgcgccaccacgcctggctaattttgtatttttagtagagacagggtttctccatgttggtcaggctggtctcaaactcccgacctcaggtgacctgcccaccccggcctcccaaagtattgggattacaggcatgagccactgtgcctggccaatagtaattttaaacaacagccaaggaagctagagctacaaactctttcgttccctatagaaactaaaggtaacatcttcacatatgtctttgagttgttttttataaacctggacccccagcaaatggaaaatgccatctgccggcctgtagacctcagataagggggaacaaggactgaactctgcctgccacttattctaaatttcttcctgaggtgcccagaggaagtcatgcccacaggccagagctcaacattccttttgactgaccccaagtttttaaacaaagcttaatcaatcacaagtcaggaaatctttgaattcacctatgacctttagtcctcccaaccccgtttcaggatgtcctgccttttttaggccaagccaatgtatagcttcattttgttgattgatgactttgcctgtaacctctgccttcctgtctatattaggcagttcttgcattgctataaagtaatacctgtgactggtaatttataaagaaaagaggtttaattggttcacagttctgcaggctgtgcaggaagcatgatgctggcatctgcttggcttctcaggtggcctcaggaagcttacagtcatggtggaatgtgaaaggggggcaggtacctcacatggc

SEQ ID NO: 88396 - DNA, 478 bp, Homo sapiens
tcttttttttttttttcctgagacgagtcttgctcgctctgtcacccagactggagtgcagtggcgtgatcttggctcactgcacctctgcctcctgggttcaagcgattctcctgccttagattccagagtagttgggattacaggcacgtgcatgaccacacccagctaatttttatatttttagtagagatggggttcgtcatctggccaggctggtctcaaactcctgaccccaggtgatccacccgtctcagcctcccaaagtgctgtgattataggcgtgagcactgcacccggcccactggtttttctgtttgtttgacaaaaggaatgccagaccaactcagtctccaaacaagcgcccagatccagttatggctttaactgagattaaatggagaatctggtttcagggaccagttcttccatttttggtagcttggttcgttatggagactaaagttcttaccatgat

SEQ ID NO: 88397 - DNA, 298 bp, Homo sapiens
taatagaatgccatttatatattttgtttcaggtatattgttaatagagcttggcaaattataaataaatatatgtatatggttagatagaagtgactataatgcacacatatgtaatatatatagacacacagagcccttcagttcaggtacaatttgcgctatgaatgctgcaaacatttttgtttaaatatttgcatttatactttctaagtcagcatttatttttgtggctgtttacccacaatgaaagagttctaataaagatgtgctgaagttgcaatataaaaaaaaaaaa

SEQ ID NO: 88398 - DNA, 233 bp, Homo sapiens
gccagaatactgctttaggaaaatcaattacatacaacagggcaatagttgctaaccagtgggtaaaaaaaagattcacatggcttttaaaatatatatttatacaagtgttggtggccctacctgggacctctaaatctgaatctctcggaacaggttatgagcttatacaggaagaaaaaaaattgctcaggtatttctttcttttctttttttttttttttttgagacgg

SEQ ID NO: 88399 - DNA, 319 bp, Homo sapiens
ttccatccacgcacctgggctccatgcacgcacctgagtttccacgcacacacctgggctcccatgcacacacctgggtttccatgcacacacccgggtttccatgcacacacctgggctcccatgcacacacctgggtttccatgcacacacctgggctcccatgcacacacctgggctcccatgcacacacctgggctcccatgcacacacctgggtttccatgcacacacctgggctcccatgcacacacctgggctcccatgcacacacctgggtttccatgcacacacctgggctcccatgcacacacctgggc

SEQ ID NO: 88400 - DNA, 432 bp, Homo sapiens
aaagatacaaccctcctagcttaaatcaggaagaattagatactctgaacagaccaataacaagcaacaagattgaaatggtaatgtaaacattaccaacaaaaaaagtccaggaccggatggattcacagcagaatgtaaccaggcattcaaagaattggtaccaatcctattgacactatttcataggattgagaaagagggaaccctccctaaatcattctatgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccgtgatcaagtgggtttcataccagggatgcagggaggtttaacatacgcaagtca

SEQ ID NO: 88401 - DNA, 473 bp, Homo sapiens
tagtagagatgggtctcactatgttgcccaggctagtctcaaacacctgggatcaagtgattctcctgccttgccctcccaaagtgctgagattacaggcgtgagctatcgcgcccggccccttatatttctttgggatagcacgggtctagaaaatgtggagaggcctgttgagcaaatgtcctcacctttttctcctgcagtgaccgggggcaccgggggtcccagcagcaatgattcccacccatttcttcagggttggcagggggacaagtctatatgagggacacccccattctctacccacagggtcaccaaatgaatctaatctccttccaggggtgaattcacttaattgtggctgaaattccatggtcacccttcacaagggttggtgaggggcaacctctagctttcctgacagtcatcaggtactagtgctccttcatcttgggttgggacaaagggcagga

SEQ ID NO: 88402 - DNA, 363 bp, Homo sapiens
gctacttgagaggctgtggcatgagaatctcttgaaccggggaggcagaggccgcagtgaactgagatcatgccactgcactccagcctggacaacagagtaagactctgtctcaaaaaaagtataatgtttttacttgtttatgggtataagtttctaaaaattgagagagccattgatagtgaaaaactgtgctctagtaatcagcaagcttctcactcctcacctcacaaatgggattgacttccttcagaataggagaaggtgaatgtttgtctccaggggcatgtctttcagtcttccagcttcttcacaagaaccccacatctcttagctgcagtccatatcatgactgcagtagat

SEQ ID NO: 88403 - DNA, 669 bp, Homo sapiens
gttacaaaggtctctcttctgcttaaaccaaatctcttacaatgaaattaaatctcatttctccatttttgatgtctggtggatttgttgtattttatttattaaagatttcttttccaaaattaaaaaaaatatggtaattaagcaatctttaggaaagcaatcactttacgctacatttctatatagcttcatcttcttcacagggcaagtcgccaaactgaattcctgagattgaagcttttccatcaggagctttggttggattggcatcacagtggtttgggtaaatccccgtgatgttactgaaacaacgaggatcatctgctgtgtgccaacactctcaccctggtggggagctgggtttattggttaaatttaattaagcataggtttagatttctgtgaccaatctgtttatattcaagtataatcagccttcttgatgtgctatttatttaatcaataaagaattcagaattgtagagttatgaaattttaaaaatatatttttaagcagttttcctttcagaacactcaatcacaaaatatatctaatagatgccattaatctcattgtaactaaaataaatttctacaatgcagtttccttctattcaaatatttgcatgatctggaagctaaaataaatatttagtgggaagccag

SEQ ID NO: 88404 - DNA, 300 bp, Homo sapiens
ctattcctaggtatttatttactcaagagatacaggacaactggagagtgaaatgagattagaatctaaaaaagcaaagttcacatttttttactttttatctttatagatctctcattgttggatttttttttaagtaagaaggtattgatgaattagtagtgtaaatttttaaaacatactatgggaatgcacatgccagatcagttatttattgggtacaggggcggatataggagagttgagggcagaaggtttatagagtacaacagatgtctgacctgagcttgaaaaccaact

SEQ ID NO: 88405 - DNA, 274 bp, Homo sapiens
aatggaaggcagccttgacagaagcgtgaccgaaggcagagaacaggagggtagagcgtgttcagaggcttagaggagacagtcagacttggccgatgtgatggcccagcagtgatgaaagcatcttccctctacggtggcagcactgtccacccactgcagcagcagttcctggctttacagttctacagcagcccctggcaaggaacctggcaccaccctcccatccctggggaaccacccaagagctgagttctccctactcccttccaac

SEQ ID NO: 88406 - DNA, 493 bp, Homo sapiens
gctttattcctgactttagagaaggcagtcagttttacttaatatgtcattttatgtcttatttgttatgttttgtttttgaggagtcatactggtagtttaaaaatactgagttttatcatcaaatgcagctacaatgtttaagcagatgacttaatctccgtgaggcatgaggtgattaaaaaatgtatgtatatgctttttcaaatacagagtaaattgcctggcagacaagaagagcttcataaatattatttagtgctttttattctagatttttgaaataaattggactcgacttgatgcaaaggatttgtactataagtttattataaaattattaaccgctagcttttgtaaatagtaaaattgatttgcccattatacatttctttttgttatgcataaaatattttaatttttaagtaccaacataggatggatttttaaatgcttcctcatgttaattttttaataaacatagaatgaatac

SEQ ID NO: 88407 - DNA, 209 bp, Homo sapiens
gatctacccacctcagcctcccaaagtgctgggattacaggcatgagtcaccacgcccggccctgattatcaatcttcaatattttgtattttgagcactttgttggatttgttatttagcacatgtatacattgttttattataatattgtgtgtaatttatttctgattaattttatatccttccttcacatttcaaatacttctaa

SEQ ID NO: 88408 - DNA, 319 bp, Homo sapiens
gagatcacaccactgcactccagcctgggcgacaggagtaaaaccttgtctcaaacaaaacaaaaactaagtgaggcacagacttgcctaggacaaaaagcatgcgaggcaaccatattgttaccggtgaaaggttttgactatgagttgacaggttcttggcgttttgaacaaataattggacaaaatgcacaaagcaaaaaaatgaagcaatgaaagcacacatttattgaaacaaaaagtacactccacagagtgtaagcaggctcaagcaaggggctcaagagtgctggttacaggattttctggggtttaaata

SEQ ID NO: 88409 - DNA, 418 bp, Homo sapiens
tttcagagagaaaggcctagacagccagatcaagtcttccaacaggtaagaagatgcgatggcccatagccatcgtatctcaattttgtaaaaccatctaaaaaaaaaaaatccattgtgggtcatatgatgaaaacttaaatggttctgcttattataattggggcttagtgtttgtggcaagaaggacaaaaacatcagcattatatatatattataaatgaagccacctacagtggaaaaggactgtgaaataacacaacagagagatgggtcatcaaaccagaactaaccttttcttttcttttcttttctgagactgagtctcactctgtcacccaggctggaaggttgcagtgagccgagatcacgccattgcactccagcctgtgcaaaagagcaagactctgtctcaaaa

SEQ ID NO: 88410 - DNA, 728 bp, Homo sapiens
tggaagtccaaggtcaaggtgtcctcaggattggtttctggtgagggctttctttctggcctgcagacagccacctttttgtgtcctcacatggtctttcccctgtgtgcatgtagaaagagctctctggtgtctcttcctgttcttataaagacaccagtaccagcagatagcttaaggccccaacttcatgactctttttaaacttaataaccttctcaaaggctccacctccattaccaatgggggttagggcttcagcgtatgaattttggagtgtgtgtagggggacacaatatatcccataacactcaccaaagtcttgcatgttttggaagtcagcagaggtctccagcccctgtgcttggatgacttcctctttaagtgagggataacaagtcaaacaacgatgtgactttggtgggaacataaagaagaaacgggggccaggcacggtggctcacgcctgtaatcgcagcactttgggaggcctaggtgggcagatccctgaggtcgggagttcgagaccagcctgaccaacatggagaatccctgtctctactaaaaaaatacaaaattagccgagcatggtggtgcatgcctgtaatcctcgttacttgggaggctgaggcaggaggatcgcttgaacccgggaggcgggggttgcagcgagccgagatggcgccattgcactccagcctgggcaacaagagtgaaaactccgtcta

SEQ ID NO: 88411 - DNA, 293 bp, Homo sapiens
taggagttcaagactagcttgagcaacagggggagaccccatctctactaaaacaaacaaacaaacaaacaaaaaaggaaaattctgcctctgccacttactagctgtgtgagctcagtagcagacaccaaccaggtacttaccagctctgtgcttcagtttcctcccctatcaacagagatgataatagtagcgcctatctctacagggttgttatgagacttaaatgagataatccaaataaagcagctggcccagtgcccagcacagaagtattagatttgatgatgagg

SEQ ID NO: 88412 - DNA, 1269 bp, Homo sapiens
tgcaaagagtacagagactacatttattgagcacctactaaagggcaggcctggtgcaaggcttttttacatctgtaatcacatataatccttagcacaaaactgagatatgttactatcttcctaatttcacattcaaaaaactgagatcagaggttaagtatatcttatcacataagcttggaaatggcagggcaggaatttgaacttaggtgcttctgactcaaatccatactcttacagtagactatctctctgttgcacatggtgaggatctttatgttcattgtggagggaaaagggagcccaagtctagagattgagtataaagtttgggccaaaagcaggagtagagtctgctggaagactcgctagcagccttagcattggcaccacctccttactaaaaccacatcttgcttcctggcagagcctagtactgttatagttggcagagcattacagggagcttggaagaacttccccggtaccttccaattttccctatttggtcagttcagacttgcgttagtgcaataacctcctaaccaatctcttggcccctatgcttgctttacctccagtctgttcttcgcgttgcacttagaacaacctttccgaagaacagaccagatcttgtcattcctgtgctttagctctttcaagggtttcctgttataattaggataaagtagaaattctttagcatggttggtttgctccttctatccctagccttacttctctccactgtgaacaccatgtttcagcccagcaggaccactattcctccaaatgtaccatgtgctctctcccctctgccgtgggcatattctgctgttcctttaacattgatccattcttcctccttttccttcttactcctacttgtcttctgtgatcactgcttaaaagtcatttttttcagaaagcttttctgaacctcttctccaacactacccccacacatgtagactagcacgctctaatatggccatcatcttattgtattataattaccttgtcttattgatataatttacataacataaaagtcactcttttaaattgtacaattcagtggtttttaatatatttacaaggttatgcaatcactatataatttgagaacattttcatcactcctaaaagaacccacatacacacccattgacagccactccgtgtttccccttcccccaatcccctgacaattattaatctactttttatctctatttatttccctagtctggacattttatgtga

SEQ ID NO: 88413 - DNA, 560 bp, Homo sapiens
taaactctactgcaacactttctaagggctctgtgtgccaaaatttcttacctttcctattcaaaactgtttatgagagtaatgaatatctggaatgagaagaaatctgattgaaggaattcattcaaacatacagcttaaccccaacccaaattaatattgaattgtttgaattctacacagaaaaatgaagttgaaaaaaatgcagatagtagggcacggattgcttttattggaaagctgacatggatcaaatccttaaggatttattgttcttcatcccttcattccttcttgtttttgagttcacagttctattaaagttccaggttgttcccttgtttattccaacctggaatgttcttcccccttccctttcaactaattatattggtcactaaccaccacttcccctacaccaattaaatcctgtttccttggatgtgatgggatattcctgtgtgctttaatgtcttttttttttttaaacttttcttttggcacttatagtcagtatcagagtatcctccagaatattttctatgtattaatcttgcctt

SEQ ID NO: 88414 - DNA, 230 bp, Homo sapiens
gagggtggggtgagatgggcactggtggagcacgcacaggtggtaacaataccaggatgcagtcatgggctgggacattcgctccccacagggcccgggaagaattgcctagaatcgctgcagtggccagtggccgggctggctctaactctcccctttgtttggcctcacaggctgtgtgggctgtgcaactgaggagaggctcttccacaaactgttttctcattaca

SEQ ID NO: 88415 - DNA, 2167 bp, Homo sapiens
cgggttttgatttctgagaagacacacacggattgcagtgggcttctgatgatgtcaaggttggatgcatgtggctgactgatagctctttgttttccacaatcctttgcctaggaaaaaggaatccaagtgtgttttaaccatgctgaccagcaaggggcagggattccttcatgggggcttgtgtctctggctgtgtgtgttcacacctttctttaaaggctgtgtgggctgtgcaactgaggagaggctcttccacaaactgttttctcattacaaccagttcatcaggcctgtggaaaacgtttccgaccctgtcacggtacactttgaagtggccatcacccagctggccaacgtggatgaagtaaaccagatcatggaaaccaatttgtggctgcgtcacatctggaatgattataaattgcgctgggatccaatggaatatgatggcattgagactcttcgcgttcctgcagataagatttggaagcccgacattgttctctataacaatgctgttggtgacttccaagtagaaggcaaaacaaaagctcttcttaaatacaatggcatgataacctggactccaccagctatttttaagagttcctgccctatggatatcacctttttcccttttgatcatcaaaactgttccctaaaatttggttcctggacgtatgacaaagctgaaattgatcttctaatcattggatcaaaagtggatatgaatgatttttgggaaaacagtgaatgggaaatcattgatgcctctggctacaaacatgacatcaaatacaactgttgtgaagagatatacacagatataacctattctttctacattagaagattgccgatgttttacacgattaatctgatcatcccttgtctctttatttcatttctaaccgtgttggtcttttaccttccttcggactgtggtgaaaaagtgacgctttgtatttcagtcctgctttctctgactgtgtttttgctggtcatcacagaaaccatcccatccacatctctggtggtcccactggtgggtgagtacctgctgttcaccatgatctttgtcacactgtccatcgtggtgactgtgtttgtgttgaacatacactaccgcaccccaaccacgcacacaatgcccaggtgggtgaagacagttttcctgaagctgctgccccaggtcctgctgatgaggtggcctctggacaagacaaggggcacaggctctgatgcagtgcccagaggccttgccaggaggcctgccaaaggcaagcttgcaagccatggggaacccagacatcttaaagaatgcttccattgtcacaaatcaaatgagcttgccacaagcaagagaagattaagtcatcagccattacagtgggtggtggaaaattcggagcactcgcctgaagttgaagatgtgattaacagtgttcagttcatagcagaaaacatgaagagccacaatgaaaccaaggaggtagaagatgactggaaatacgtggccatggtggtggacagagtatttctttgggtatttataattgtctgtgtatttggaactgcagggctatttctacagccactacttgggaacacaggaaaatcttaaaatgtattttcttttatgttcagaaatttacagacaccatatttgttctgcattccctgccacaaggaaaggaaagcaaaggcttcccacccaagtcccccatctgctaaaactgatggctacatggaaaaagaggactttcttgcacattaggaagcagaatatcctccagtgtagcacagggggagaagtgagaagtgttatgacattagtgccctgattgggcagcacccacggctacagtatcaggtcaggtttctcgtgtctgtgtgtttggcttctaaagacaagaatgacttacaatacagcctaattatgtaattaacatcaagccacactaaaaagttctgctgtacctccagtggatgctgtttctcagtattatgacatgtgacaggtgaactctgggaattggaccatgcaacatttgtgaactgtttgcaacactttgtgaactattgcatccttgatttcttgtgcatgtctctgtaatgtaactcaccctcctcagcattatttgatacactgattgttagtttt

SEQ ID NO: 88416 - DNA, 174 bp, Homo sapiens
gtcaatgttgccttgcctgggaaggaccacccgggcaatcttatatatctactgttctctaaaaatgccacttagaagagaattgaaacttccaaacacatgaaaggatccaaggaaagtgtcttcaaacaattacatatgagctttaagtggaataaaaacagagttaccatg

SEQ ID NO: 88417 - DNA, 334 bp, Homo sapiens
agctgtcttgagaaatatgggaggattactgggtaacattattttaccagaaggcagaataaaggacagtagggcaagataattaaatatattggcaagagagtggttcacttgacccttgggatcttatttggatagagatgaaaatgaagacaggataagactgataagtaaaaataatagtggtgaagacactgcgaggttgtgaaaaatataaggaagtgagatttttggaaggctatgtggttgtggttagaaagtaggtcttttggaggaggacagtttcaagtgtggctgtgaaaggagtagctaaagtcttggaggtgtagaccac

SEQ ID NO: 88418 - DNA, 671 bp, Homo sapiens
ccagctataactgaggtcccaagccaaactgcacggcaagtctggggcagagatgggtcccgacgtccctgggctgggcccagggttcccggctctgtggctcacgtgccgcttgtgtgatgtagagactggcttcgggtgccgtgaataaaccatggctgctttctcaaggtttgctttggttcctttctgttgtggtctgtgtagtgagaatggtgggagtcttgcacgtgagcagttaaggagtgtgttcagagctggaagtcttggttctgagagcaggctagcctggtcatagttctcatcgtttccgcaccgtctctaaaaaggtgtcgctttgcaaataacatttaactcgtgttctccccagggtgagattctgccaggagcacctgccacagaggccagcattggagcctcaggggctacgtgcagggccaaggctggccttctccctctgggggacgccagtggaggtgacctccacagcacgccggccagctggcaccaagctcctggatgttgtggctgtgtagaaccagattctgtcttgtggtactttgtccacgatctcaggagagaagcgctagtctgcccgcccgcgtgcctgccatgaaacgggtcccagggcctgtgtgcgtcttacttttgtttgggttggaaagggtgac

SEQ ID NO: 88419 - DNA, 1666 bp, Homo sapiens
tgagtgatagaattttgttgtttttcatggctaaatagtactctgatgtgtatatttgccccattttctttattcattcatccagtggacacttaggttgattacataccttggcctatttcttggctatcgtgaatggtgctgcaataaacatgggggggtggagataacactttaacatactgatttccttttctttggatatgtaccaagtatcatataatagtatgacatgactcaaaattaaggaataagattgtggaaattggttttcaaaaaaaaattctctagtttgaatatagagaaaaattggtgagtgtcttcagctgtcctcatacataatgcatgtgagctcgctttaagcataagtgaaggagtggaaaaatcctggagatagaaatcaaggggtatacatgtggatgtaaaaaatcaacaaagattcttttaagaaaaggtgtgtatgggtagggaacaatagcatgacagcagtgcggcctctaacagtctggaaccagttaggacaaagagcaggattgagcgccattccattcatagacaccgtggtgatattttgagtacattaggttaaaaggctttcttcagcaaaatctatctctagagatagatttgatttttataatcaaatctactagagatagatttgatttttataatcaaatctaccagagatagatttgatttttataatcaaatctactagagatagatttgatttttataatcaaatctactagagatagatttgatttttatacttaatgttctagactgtatcttttcaggatgctaggtactttatgaagatccatgctgtctcaatttgcatagtgggttggaggtccctaagacaatctctccagattctatgatttgctaagaggactcagaatatagttgtactcatgactatattatagtgacaggatacaaataatcagcaaagggaaaaggttcttgtataatatctggagggaatcagatgtaaatttgtaaagatcctttgtgcatggagtaacaggtctcaattcctccagtattgaattgtgactgtacttgtgaaatgtctacaatggaaattaattatcaacccgtaccaaaggttcttattggaactaatcatgtaggtaccatccctctggtacatatcaagattctagactccaagaaggggagcaagtgttcagaataacttgaaccatgcctaccagttatggaatggtggcaaccctctcaaactccgtgtttcctaacaccagctaaaggccagtcttataagcagtcctttctaagatttgcagtctcaggcctgttatattaactttttgtgcacatagtactagaaaactgttggctcagtcttctttttgttttgtgtgttttggtttttaactgtcaccgataccagaatagctcatctccaaggtaactgtaacagaacactcagcagattaaacagaaaatacttgcttattataattattaaaagtttggtagggtctatgtctgctctctggtgtgtcctggatcatcaacttggttacaacatggtgttaacatgtgggactgattgtgtttcttgttaatatttctgtttctcccaaccacgctgaatattaaatacctagttctatatctagtaccctga

SEQ ID NO: 88420 - DNA, 782 bp, Homo sapiens
cccggctgggaatcaagattgtgtggctgggaagacaccagtctctgtgctcgggttcagcccagtcgggcaagaaagtctgggcagctggagaaggtcgtcacagtctcccgtggaatcttgttgcctgagagccccataacggaaagggctaagacgactcttccacacacaggtcgcagcccctgccgcggaggatccccaggaagatgctggggacgctctgagcatcggcctttctttacccccgactccctggagcttggtctcgggatgccaacttggggcacggaggcgacgggctgctccgaagctggagggtttctgcttgggtcagagggatcacgacctcagcagagccaggagaggttgggtgacacccactgcgtattgcacttgactcaaaactgccctcggcctgcggaagaggcgagggcaagaagcctggtggcgggtcaaaccttcaccctattattttctatcattttttatgcccatatatttgttaaatgtatggctgctatacaccaacagcttattctacaagaagtgcccccgaggaggattgggttaagctttgcaaatttggcttcccaggtaatgcgcttcattattctgctcccgacttacccaccacaccagtgggtacccggagcagcacccacttggcagaactgatgactgcttgggcccagcggagtgcgcattgcgctaacacgcgcacgggaattgcacccttgccggagcctccgcaccgtgcgcccttcaaagagctggcgacc

SEQ ID NO: 88421 - DNA, 393 bp, Homo sapiens
ttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatg

SEQ ID NO: 88422 - DNA, 417 bp, Homo sapiens
ctgatctagaggatcccgaagttaagggctacctaccttaagcatgctcagaatacttacattagtctacacttgagcaaaagtatctaacacaaagtttattttataatgaagtgttgaatatatcatgtaatttattgaatactatattgaaagtaaaaaacagaacagttgtatgggtactcaaagtaaggtttctactaaatacatattgctttctcaccatcctaaagtcaaagaatcttaagttgaactattataaattgggaaaagtctgtatatgaaaccatcaatattagcagaaatttaaaggttaaaaagtaataatgcaaaaactggttttggatttagtttttgtcaaaagcgaaaaataaatattttcctgctgtttgcttacatttatatttaatctcctgt

SEQ ID NO: 88423 - DNA, 355 bp, Homo sapiens
gtttatgggctacctccagtatatctattattatgcctattatgcaaatgagaaaacagaggctcagaaaagttaagcaacttacacaagatcttgaagtcagcaaataatgtagcagcttctcaaattcaaaacatctgactccatgttaggtgatataccctaacaccattatatctttcctagtataaggatggactcaatctctgagacctcttttaagtctcagattctgtaggtctttatttatgagtatgaagttattcaagtaatctcatctatctggaatacaggcaaaaaccaggaaataatttaaaaaaccagtgaaaaaggtggtgggggcatgtgtattgat

SEQ ID NO: 88424 - DNA, 462 bp, Homo sapiens
ggataatagtggtaacagctagtgtttattatcaagtactaggtaaagttccaagttctttgtatgtattcatttactaaatcaccaaaacaacccgttacttactatcctctttttttttaaagaaatggaaactgaggcacagagaagctaggtaacttgctcaaggtcacacacctggtaaacaaggatcagggatttgaacctagacagtctgactccagagtctgtttccttaattacttcatacagtgcttccctggtctaacctggtattatgaggattaaatgcaaaacaaaacatcacacacacacacacacacacacacatacacacacccctcttttagcaccagacttaatttatagaaataatacaaattaataatctttttagaagacatatcactgtatgttatttcatcctctcatgaggatcacaaaatggtattatattactct

SEQ ID NO: 88425 - DNA, 335 bp, Homo sapiens
ttctaacaaaataccatcaactgggtgacacagacaaaaggaatttatttctcacagttctggaggctggaagttcaagatcaaggggccggcagatgtggttcctggtgagggctttcctcctggcctgctgtgcccttacaaggcagggagagacggagcacttgggtctcccttcttcttataaggacacaaatcccaatatgggggccctacctacatgacctcatgaaaacctcattgcctcccaaaagttccacatccaaataccatcgcattgggagtcaggccttcaatatagggattttgggggaagacaaaaacattcagtccat

SEQ ID NO: 88426 - DNA, 367 bp, Homo sapiens
gcactgatcttcatcacgctatctcttttaaattcaatctgtaaccaatagctacttacagtgtgtatataagcactcaattccatacttataataattgtacattgagcacttttcaataagcatttgtctaattatttatgagaatcatataatctttattacaatctattttacacataaataaactgaaaaaaatgtttttgtaaattgctcaaggtcttatcaaaagctaagatttgaggcaaatattctatcttaaaaagtggcattcttaactatatcccaaggtagtggctaagacttaatgacataaatatataaattaggagttactttctattgggtaattcaatttgcctctttg

SEQ ID NO: 88427 - DNA, 284 bp, Homo sapiens
gagacagggtctcactctgtcacccaagctggagtgcagtggtgtgatcacagctgactgcagcctcaacttcctgggcgcaggaaatcctcctgccttagccccccaagtagctgggaccacaggtgcatgccaccatgcccagctaatttttattatctgtagagacggggtctcactatgttatgttgccaaggctggttctcttcccattttaaacctgtttctgattccaggaaaactctaaaataggataatgatttaagttatcatttattattaat

SEQ ID NO: 88428 - DNA, 746 bp, Homo sapiens
gagattgagtgatggtgagcgggaggaacaatggtcaagggaggttttcatttttaatataattcttgtgcaatattccatgcatcagagtattataaggtctgtgtatggttagaagaagaataaaatgaacatgatttacccatcaccagagagaaacaaggactttgggggccctcccgttccccttccatgcacatctccttcctgcttcccagaggtaaccactttgttgagtcaagtgtttattatttgagaaaggttttttttttaaagcccttgattgggtgtaaagctatcatttaactaatttcctgacattctcctagttttgttttgttctgacacatttttaaagttaagttttatgtcatttataatgatgctaaaagcattttggcaggagctaggttaattctctgtagccttttctcttggcacatgtgaaagagaactgctggttggcgggtggctcacccctgtaatcccagcactttgggaggctaaggcaggaggatcagtagagtccaggagtttgagaccagcctgggcaacatagtgagacccctatctctacaaaaaataaaaaaaaaattagccaggcatgatggtgcttgtctatagtcctaactacttgggaagctaagctgggaggatgcttgagcccaggggtttgagactgcagtgagttataatcatgccactgcattggctctttggaaaaaaaaaaaaaagagagagagaga

SEQ ID NO: 88429 - DNA, 267 bp, Homo sapiens
gccctgatagattaagtaactcaccccaagttgcagagctagcaaatggcggcggtatcctgcctccttataaggttgttgttgggcatagacgtgaagccccaagcatacagcatacaataggtgctcatgaaatgatggacattattaggaagaaaataaggagtctcctaaatgagcagacagtgatgatggcattgccaggatgcacctgagacctccatgctgcacacaagccttgcgcattttctgggatctgtgcctggc

SEQ ID NO: 88430 - DNA, 447 bp, Homo sapiens
ggatctagaggaccccatgggtgctccatcccccccaaacacatcttttgctttctaatttgttaagcttaactgtaatctttaactttccaaagtgaaggcaaagaaattttcttaatgtatttctttgtgatagggaaaaagtgatacttttcttctacttcgtcttcaaatttcttctggaattttttttcagtgaccttatctctactttttcattttccctattataaagaaaatagtcatctcttctttcatacatttatcttttccatatttgatgagcacgcctccccgcacttaagaaaacattgtaggaaaaaaatattaatctaaaattgtacattgtactctaatatctgtttttcatttgtctcccccattagactctaggcttcttgaaagatttcttctttgttttctacacccagttcctgcctgtcatat

SEQ ID NO: 88431 - DNA, 352 bp, Homo sapiens
ccttggttgtcttataaacattttgttttgttttacagtatgtttatttggatgagatttaagacaaagacaatacactacaaatagatgtcttttgagtctgcttccccctattttctaattattttactaatacagtgtttgctttatatacgttcttcttattcaaatacataacattatcaccttgataatgcaaataacacaatatggaggaagattgagaacataggctcccagtacttagtcactgggattatagagattttccttttagtattttctatcaaaatttaaagatgtcctgccatggctgtgcaagaatagaactgtctggaatgggagtgcaatg

SEQ ID NO: 88432 - DNA, 492 bp, Homo sapiens
atgcagtcaagacatttgttgaaaatactatacccaggttcagattaatagaaaatgttgattcagataataggactcatttcactacaaatgtcattaagaaactagcccaagtactggatataacatgggactaccatatcccctggcacccaccttcatcaggaagagaagaatgaactagactctgaagaaacacctaaccaaattagtcctagagattcaattaccgtggattaaatgcctttccattgtcttgttgagaatctgaactgcccctccaaaagatgttggcttaccccttatgaaatgctgtttgggttgctttgtttacactccactgctgacattcctacatttgaaacaaaagatctattccccaaaaactatatacttggtccatcctccactttctcttcccttagaaccaaaggcctcctagcacagaggccacccctcgaatttccagttcaccaccaccagcctggagac

SEQ ID NO: 88433 - DNA, 340 bp, Homo sapiens
cagaaaattaatttttaaagggcaaatgtacttactatacaaagatggaaatcttgcaagttatttttattgcatgctttcgtaacaaaaattgggaaaatgatcacccacaaggccaccacctttattaaagggattgcttgtctttgttctcttctagtcttagtccatacacataaatcttttatctgtcttgtaaccacaatatcaattctattctgggttcagggattttctttttcaaacatcaaatgtaattcatgtgtctacaccagtatatgggagagttcgttcccctcaaccttacaaacagtgggtgttacagctaatctcacaggtt

SEQ ID NO: 88434 - DNA, 561 bp, Homo sapiens
aatacaaccatgtcttgttctctagtgtcatgaaaggccctccctgcatctgcattaacaaaacagcttagcaaggtagagaccttcataaaaatatccagagctgaccatttctcattacctccactaccgtcactgtgagctaagccaccgtcacctctctcccaggatactgcaatagcctcctaactggtttccctgtatccaccctcactccccaccatctactcttgacagtaacctaaatgagcctgttaaaatgctagtcagactgtgtcactcccctgctcaaaactctctgatcatggatcagtctaagtcctggcaggaaacagatggcacaaagtgggtgatttgaggagagtttataaaggaactatttacaaagatgtgggcaggtgtagggaaaccacaagagaaaatgcagtatctggagctggtaaatcaggggtacctgaactcctcatagacctgaaggtgtgaaggatggagagggagggagacaaagagctccgcagagaaggcacatgacaggaaatgtgaccttaagtctaaggaaac

SEQ ID NO: 88435 - DNA, 405 bp, Homo sapiens
ccattgactgaataatgcataagccagaatacatacatataatggaatactaaccatagcagatgtgaatgaactagaaccaccagaaccaatccaaataaatgtcatcaacagaacactgaagaggagagcaagttgacagtgtggcatcctttaaaaaaattttttaaatgcgaaatgatactatatatcacttttgatacacatgagtggtaaaaaaaaaactgctcctgcacacatgggaatggaaacacaaaactcagaatgggtggagggagcagctgagttcaggcaaagaccccacagcggcatcaactgcgtgtgtgcgctgtcctctttcccatgctggatggagatacggtgtgttctgtattacatcagcctgtgtgccccttctgaatgtct

SEQ ID NO: 88436 - DNA, 378 bp, Homo sapiens
ccggccaggccccaccctttgggagagccctgctctgactgctagaagccaagcccctctccggggaaagcagaggagggcggtggtctctgtgggtacctgcggctaacagcctggccaggacagggacctggccccctcttgcccctgtacacaagggcggccagtcctcatgtgagactcgtggccccagagcaggctggagcatcctagggacatggacaccctgggtttgcctcttactgttgggtccagccatgacaagggtgtgctctagttcatgttaatataaggtgacccccagcccctaacacccctcctcccccagcacaacaccaaaacccagggcacccacctggcagccaccacccctctccc

SEQ ID NO: 88437 - DNA, 489 bp, Homo sapiens
tctgcttggagagttgaggtctggttgtcagtatctgggaactcaggaaaagagggttgggtaaggagccaaagaacatttagtatattgggctcacacaatctgtctctgttaggatgcctatgtcttccaccttgtatggtttaccctcttgagaagagaaatctgtcacctgccacattgagggtggggccactcagcagcttggaagaaatctgggattctaactgttcagcattcacttgctcctttcttttagtcccccttccactctttgttctggcagttcctgagccttttgaggaatctatggcataaaccggtttgttcttagttgtcagcattgctggcttagaatttggccatctttggcggggtgcagtggctcacccctgtaatcccagccctttgggaggctgaggcaggcagatcatgaggtcaagagatcgagaccatcctggccaacatggtgaaaccccgtctctacta

SEQ ID NO: 88438 - DNA, 891 bp, Homo sapiens
attaccaatactgagttaaatattttaggactacttcattatctaggaaatttgagaagcaaattaactctttgctcagagtattgtgataccatatcttttcttgtaaaataagatattgtttaattataaaatattgtcaaatttctgaaaaagtgtttatataagtgttaggaatatgttagccctgggagccatgtgttacttatcattgtacagatcttcttgctgacacaactgggtatggtagacggcctgatatgattaactgcaagtaaagcagaaattattaaaaacaatattgaggccaggcaaggtggctcatgcctgtagttccagcactttgggaggtcgaggcaggtggatcacgaggtcaggcattcaagactagcctgaccaagacggtgaaaccccgtctttactaaaaatacaaaattaggtgggcatggtggtgggttcctgtaatcccaggctgaggaagataattgcttgaacccagaaggtggaggtggaggttgcagtgagtcgagatcacaccaccgcactctagcctgggtgacagagtaagacaacgtctcaaaaacaaaaacaaaaacaaaacaaacaaacaaactaaattaactggatgttaaatgtggtttctttacatttaccagaatttctgccaaggtcctaatggccccaaataataggtgctacattatcaagcagatatatcaagagattgtgataatgttaatgaaacccctttgctcatcactcatttccaaaatttatattttcaaagggaattttgtacagagttcctaaaaaaagggatcatgatgccagtgtattgcactcactgattgctaaatgaagaggactatactgaagcattcaaagaacgtg

SEQ ID NO: 88439 - DNA, 168 bp, Homo sapiens
atccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaa

SEQ ID NO: 88440 - DNA, 122 bp, Homo sapiens
acataaagagctttattttttttctagctatgtattatatctttgtagggatgaattttaatttatataaccagtctcctattgatagatatttaggtttattcccctcactcaccctttgc

SEQ ID NO: 88441 - DNA, 346 bp, Homo sapiens
cagtggtgactcattacgtcctcattttttgggacctttgctcttgcaagtagttttatttgctaacttcccaccagttcacatgatagcatcctgggctaagcatcaccatctcttgcctggcttgttatacaagtgtcctaatagtttccctgcttccaaccttgccctctacactccatggcagccagaacaatccccttaaaacttaaggcagatcatgtccattctctccttaaaacttagaagatgtttcccacttgcctcagagtaaaagcctaagtctccgtagtggctgactcagcctgcatggtccagtcccctttacctcactgacctcttctcc

SEQ ID NO: 88442 - DNA, 245 bp, Homo sapiens
aaggtcagcaccactacactccagcctgggtaacaagagcaaaactccaactcaaaaaaaaatgaagcataatatgaagatcaagaatgaaacaaggactacaaagacatttataatatagtggtgttcaaagccatcaagagaaaatcagaaggttgtcagaaaactggggaaagaaaataatcaagaatggaattggaggccaggcacagtggctcacatctataatcctagtactttgggag

SEQ ID NO: 88443 - DNA, 747 bp, Homo sapiens
  misc_feature (741)..(741): n is a, c, g, or t
ccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatacgagaggtatctgagctgcttttggactaggtgatttaaatgtctctttttgttctaccttctggatgctttgatttactgacttgtgaagtgtcttgcccaagatcacgtagcccattaagttttcgaagctgattctctgacacagagatggttaaaagctacacatttgactctcacattcatacacgtaggctggctgtgggagatgaaaagctagaataagaagttctagaagatccatgaccaancccaaa

SEQ ID NO: 88444 - DNA, 524 bp, Homo sapiens
ctctagaggaccccttataagacgacagaagggcgagaggtatctgagctgcttttggactaggtgatttaaatgtctctttttgttctaccttctggatgctttgatttactgacttgtgaagtgtcttgcccaagatcacgtagcccattaagttttcgaagctgattctctgacacagagatggttaaaagctacacatttgactctcacattcatacacgtaggctggctgtgagttacctaatacgagccttttaaaagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttctgtcgtcttct

SEQ ID NO: 88445 - DNA, 385 bp, Homo sapiens
aataaatataaatattaatttttgtaggcataataaacaactattttctttgtaaaaacattctttttatattaaaaaaactaggaaactaataaaaaatggaaacccgctgccatgctacagaaggaacttctgtttagctggttgatctagtttctagtccttccaaaaagcatttttacacacacatgtccataatgattttcttttgtttttatgaaaatgagattgtacattatgtattattctgtaagttgccttttttcactgagtgtatcttggtaatttttccatattagtatatatgtacacctacctctttttaactgctacatattattccataatatgaacataatagttttattgaaccatttcctaatta

SEQ ID NO: 88446 - DNA, 197 bp, Homo sapiens
tgggcaactgtaatcccagctactcaggaggcggagacggaagaattccttgaaccgggaggcggaggttgtagtgagctgagatcgcgccactgctccccagcctgggccggagccagactgtgtctcaaaaacaaacaacaaaataaaacaagaaaagatttaatggaagacctcaataagccattgtaggctgt

SEQ ID NO: 88447 - DNA, 364 bp, Homo sapiens
atgattaatgtttagcacattgcctggtaaatagtaagagctcaattaaacattaccctctcatcttcattatcactggagatccacgtagtacttagaaaatttgtggattactgaatagcattgagctacttctgaagagaaggggcaaatttgtttcatttgggatgcattactggcagttttttataggtctttttggatttatttatttatttgagatggagtcttgctctgttgcccaggctggagtgcagcggcactatctcggctcactgcaacctttgcttcctgggttcaagcaattcttttgccttagcctcctgagtagctgggattacaggtgcctgccaccacgcctggc

SEQ ID NO: 88448 - DNA, 456 bp, Homo sapiens
gtaatacggagtgctggatgaggaaagtgagtgaagattgacctttatcctgtctcagaatgggaaagttctttttaaaacatgaaagaaaaagattaaggtgtcttatactataccaagttttttgaaccacctgattttattaaaatgtaactgaccaacagaaggatgttttaaacaaatatggcagacaaaaggtggatgtatttaatatataaagagctttaatgaatcaataaaaaaatcacttaatacctaaatagaaaaattaataaaaggcatgaccagactgtttctacaggaaaaaacaaaaaacaaaaatcagtgtatatttaataccttctgtcttatttttacaaaatgttctgaggctcatcaaactgcacccttgaaatgagtgcatttcattgtatgtaaattagacctcaataaagttgatgcacaatcttctgatga

SEQ ID NO: 88449 - DNA, 1609 bp, Homo sapiens
tgaaaattatagaatattaaaagaagtaaattcataaaattataaattactaatctttaaaatattcttaaattttgtaaaagtggagataaaaactgctaaatattaagaagtatagcatttcctagatctaccagcttataagaagccagataaaatctcagatggaaagaaaccagtttcttctggtatgtagcacacagtagccattcaaaataaaatacatggatgagctttagagtaaaacaaaaaattataatgctcttcctaagcatctctcacagtaaaaactcactgtccaataaagagccaaagaaaggaaaagaagaaaaatgttaaagttaatgaagcatagtacttgtcccaagtaatattatttaataagcttaattttatgagttatcattatcaataatttctatttctaccaagcttaattatggtaaaggttaattttaaacatgttcacacattcttttttaaaaaaatgccctaattgaggtatatttctgaatagtttcagcaggttattttttaattttaaaaaagcaaattcacaaacctagacccatttattttatactcagcagaagacagggaaatttaaattagacaaagttgaaaaagaatcagaatttatattttacaaagcttctaccactctgaatcaacaaaatcaggaatggaaaaaaaaatttctgtatctgctgaattattaatgccactatagtattatatgctaaatatgaaagcagtgctgccatcagtttcacttctgccttggaatcttgctcctaagttagctctgtggcataacaaaattccagttaataaaattttcatttaaatgtcttttgtatggctaaatgaatatacagattcttaaacatctaatttttatatggatttctcaaagaatgccttacagaagagcattctctgattaaatgcaattacagttggagtctttgattcttcacagaattctgtagttgaagccagaaaacactgtcatttaggaaagtgttcctaaaggtttgaatgctttaacatgctcaactcttacttcttgaagtgtttgattgtcagtaaattttcgaagaacattaaagttctaccaatgtagaagcatgaggaataaaagatggtctggatcaagaatgcaggaatatgatacttgtactttgtttttgataattttcattgcttataacaatgaaaaactttaatatttgcaggagactaatatgaaatgctacatttcataacttttattctgcgtggcaactttgatttgtggtggctgcctagaatgctttattgagaaggattctgaggttacatccaggatccagggggaaaaagttttctggatccactggcattgacccttatatagaggggaaggagggtcttaagggaaaattagccatctcagatatttgccatccttggataagagcgcagaaaatcattcatgttttagaaactggtatcgccatttgttgaggggaacaaaatgtagtttcctgactataattaataatactatgatatagtccaatttagctatgatataattaataataaactactttccagtcttaca

SEQ ID NO: 88450 - DNA, 264 bp, Homo sapiens
actgaatgagtcaaatatgatatttatagggccttaataaaagcttttatctagctaggttgtattattaaatgtcaaacaaactaaatgaaaagctttcaacgtgaaggctatccaaaaagagcagaatgagcagagcattaaaaatgttgaggtaccaaggcatcatgcattgagtgggggctttgaggtcccacagtcctaaatgtgaaactcagttctgccactgaccagttctgtgaccttgagcaaattatttaatgt

SEQ ID NO: 88451 - DNA, 435 bp, Homo sapiens
gtggaagagttcccggccgcagaatttttgtatttttagtagagacggcgtttcaccatgttggccaggctggtctcgaactcctgacctcaggcaatccgcccgcctcggcctcccaaagtctgggattacagatgtgaaccaccgcacccagtctctatttagtttttgggatcttccccccatcatttgcagctgaactgatcttaactctctggcctgcccaactgaattgttaatgctgctgcagctctgaatgggtgctagtttgggcatgccagtttgggcatgtggtgtacaggtgggggcaagtatatgtcagaatcctgagatggagtccctcaaatacacagcagaccactatcactggcaacccagcacttacacaagtgataaatccaaaaaacactagccaataaagaagactcagggatt

SEQ ID NO: 88452 - DNA, 312 bp, Homo sapiens
gcaagttttaattaatatggcccaaaaatttgaccttgaaggatatttgtaaaccagagagtatttaattaactaaatttactgtttctgaaaagcaatattttcaaataactgccaaccaaagtgacactatagggatgtcatttgtacatgacaatttttaacaatgtaattcttaccactctcgacagacctgaatatgtttactaataactttgccaaatttttcaacttctagaataacaagagtgagtcttttgaacttcatcattttgcaattgaaataaatcttgtcctttcacctatatcttc

SEQ ID NO: 88453 - DNA, 1013 bp, Homo sapiens
tttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggcctagatataggaagggcagaataagcacttactccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatggaatgggtattattcattgtagttgatcctggtgtgtgtattatataaagagacccctccccttattttgtgttttccatccctctcccttaacaggattgaaataaaacatgcttctgtttttgtaaaaataaaaaaaatc

SEQ ID NO: 88454 - DNA, 831 bp, Homo sapiens
tttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggcctagatataggaagggcagaataagcacttactcttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatggaatgggtattattcattgtagttgatcctggtgtgtgtattatataaagagacccctccccttattttgtgttttccatccctctcccttaacaggattgaaataaaacatgcttctgtttttgtaaaaataaaaaaaatc

SEQ ID NO: 88455 - DNA, 945 bp, Homo sapiens
  misc_feature (880)..(880): n is a, c, g, or t
tttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggcctagatataggaagggcagaataagcacttactccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggaacgtgtgatttaaggagaacttttccnttaacttggggttttcaacccttttcccttacaaggttggaaataatccatgctctggcttttgc

SEQ ID NO: 88456 - DNA, 961 bp, Homo sapiens
tttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatggaatgggtattattcattgtagttgatcctggtgtgtgtattatataaagagacccctccccttattttgtgttttccatccctctcccttaacaggattgaaataaaacatgcttctgtttttgtaaaaataaaaaaaatc

SEQ ID NO: 88457 - DNA, 588 bp, Homo sapiens
gggagacaaggggcggtggtggacctcaccttcaatccaagttttcaaagatattttctcaataaccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatggaatgggtattattcattgtagttgatcctggtgtgtgtattatataaagagacccctccccttattttgtgttttccatccctctcccttaacaggattgaaataaaacatgcttctgtttttgtaaaaataaaaaaaatc

SEQ ID NO: 88458 - DNA, 394 bp, Homo sapiens
gaaaagtggcaataaagggggaggcatattataaaatgctataatataaaaatgtagcaaaaacttgacagactagaaaaaaaaagatctgtgttattctagggaactaatgtaccccaaagccaaaactaattcctgtgaagtttacagttacatcatccatttaccctagaattatttttttagcaacttttagaaataaagaatacaactgtgacattaggatcagagattttagacttccttgtacaaattctcacttctccacctgctcaccaatgaaattaatcataagaaaagcatatattccaagaaatttgttctgcctgtgtcctggaggcctatacctctgttattttctgatacaaaataaaacttaaaaaaaagaaaacaa

SEQ ID NO: 88459 - DNA, 347 bp, Homo sapiens
gggaaaataaacatattttgaactaaatggaaatgtaacctattatagtttgttggatgaagctaaagcaatgctcagatggaaatgtatagcattaaacgtttatacaggttgagcattcctaatcccaaaatctgaaatctaaaatgtttcaaactcgtaaatattttgagtgtcatcatgacagctcaaagaaaatgcttaggggtgctaaaccagtaaatataatgcaaataatccaaaatccataaaaatctgaactctgaaacacatctggtcccaagcattttgaataaggaatattcaacctgtattagaaaaaaagtaaagcagccagactccatctt

SEQ ID NO: 88460 - DNA, 262 bp, Homo sapiens
ctaaatatcacacttccttccacccgctggcctctgtgtctttgaagtttacccaggaggtggtgcaactttgtgttgctgacatagcttggaaggctttttctgaggatgtgaacctgattgtcaactctattcaaagtcctgtttcggaaatcctccctgttccggtttggaggcgtcctctatcagaaactacacaccagcagagatgcctgcccagtttatatttttctctgacattgattaaaacaaagaaaacagc

SEQ ID NO: 88461 - DNA, 621 bp, Homo sapiens
caaactggaaatagaaggaaaatggtgggcaaggggtccagaggaaacagatgaaatcaatcggcaacccaaggtggaccccttagctgaagacctctcttccctcagcaagagccagctctggctggttgagaccaggtagtgggatgcgtgatggcactgtcctcaaaatctgatgcgggctgcccctggcacctctcccctgccccaaagcagcagggtccctgcgctgccccagacctgcctgcaggatgggccccagccctaaggtgggaagggggcagatctagggtccacctagggcagccctgggagcttctccatggcctggtgctaccccgcactgctggccttccttcctcgtgactgtctcctcagcctaagactacaaatctctttctctccaaaccattccccgggtgggttttatgagaaaatctctggcatagtaacaaggcaccacagcctttaaatctctgctctccccagagtggggcaggtgccatcggaaatgcagctaaacgggagaataactcatcttgagcgggcagagctggagggcctggtcgtggagaggggagactggctgggtggcctccatcagggtgcacctgtctcacc

SEQ ID NO: 88462 - DNA, 171 bp, Homo sapiens
gccaagattttttcttacttgcctcctcagtgtcttctgcagttacattgccttcactggtcatgagaggaggggctgtggtagggccttgaaggacgcctgtggagccagaggccattggattgcaggcagccaagagctacctcgcccctgctatctgctgtggccctc

SEQ ID NO: 88463 - DNA, 261 bp, Homo sapiens
ttaggagctctgcatcaagaactggggtcaaagacgaaatattagaacataagattttcctagcactccttttgcttaggaaatgacaagttttagaagctctgtgccaggaaccagggacaaagaccaaagtctatagttcttattataaatcacaatatcacagctggacagagaggccagagtgttactgtagggcagtcctccacatgaaatcacaactattcaaactcagggaggtcttttatacatatccgcgtg

SEQ ID NO: 88464 - DNA, 212 bp, Homo sapiens
ctgacttgtttgggtgaccttggataagttatttaacttctatttgcacctctttaaaaagggaatgttacagtgcacgttgtaattaataatataataatcataatgaactttaaggccctgaaacactcagtagatgtaaaatatagttaaatactgactgtcaaataagaagctgctgtcttgacattgataatcagagtgaaaggacc

SEQ ID NO: 88465 - DNA, 406 bp, Homo sapiens
gcccaatcacgacactgtgtgcaacctccccaaatcacccccactctctgcaacctccccaagtctcccacactctgtgcaacctcctcaaatccccccactgtttgcaacctcccaaaatctccctatgcgcaacctcgcaaaatctcccccactatgtgcaacctcctcaaatccccccactgtgtccaacctccccaaatccctcccactgtgtgcaacctcctctagtcccccactgtgtgcaccccccaaaaatccccccactgtgtgcaacctcctcaaatccccctactgcgagcaacctcctcaaatctctccactgtgtgcaacctccccaaatcccccactgtgtgcaacgtccccaaatccccccactgtgagcaaccttcccaaatccccccac

SEQ ID NO: 88466 - DNA, 376 bp, Homo sapiens
gtaaagcaatttcaaagaaaaattattcattgttttggataaataagagcatatcattgaattagaaaaagagacactggaggaagactttgaagatacttaagttggatgtaatgactaactgaccaagggctgaggaagagggaattaaagctataggggaatggattgctttttaaaggaagagatgttatgggtgttgtgaatgtgtgtaagttttagttttggggacaggaatttaggaaagattattcttcactaatacaatcttcataactaactcgttttctgtgaatagaagtggaaaatgcaaatggaaagaattcacagagagatctgaggctccagcttaaagaggagacaataattttgcaat

SEQ ID NO: 88467 - DNA, 118 bp, Homo sapiens
taatgaaacataagagtatataataatgtataaattatgagtgggccaagcagtttctgttacaagaaagaggaaattcatgcaggtgaccatacttggccaagccctcatgcagaag

SEQ ID NO: 88468 - DNA, 285 bp, Homo sapiens
tgtatttcatttggatatatgtgtctgcactacagaaattaacacttttcatataattggaatcatagaaaatgtaaaccttttctgtgctgctactagcttttaaaattgtaattttaaataattgaagatgatttctcttggttaaagcataaagacattgcatttatattacatggccatttcccgataaaacactagaattcaggtggttttaatatttttggtattatgcttcagatttcaaagacaccttggagcatttaaatttgtccctcttctgga

SEQ ID NO: 88469 - DNA, 321 bp, Homo sapiens
ttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgcc

SEQ ID NO: 88470 - DNA, 387 bp, Homo sapiens
gtagagatggggtctctctgtatggcccaggctgctctcaaattcctgggttcaagcaatcctcctaccttggcctctcaaagtgctgcgattataggggtgagccatcacacccatccttaccatttattaattgtactttgtgcctaataaaaaacaaacaaattgtaaaggtatatcagacctgggcaagattactgcatgctcagtgtgtagcaaactctctgatttaggtcaggtacaagtttatggtggaaatagtaaaaactaattcatttatctgaggttcaaggagcaatattgtcttataaagggtaatgagacaggcacttgaaccaagacctgcctgtgtaactatatctcctaagcttaaactgtaattatctg

SEQ ID NO: 88471 - DNA, 336 bp, Homo sapiens
gtacattttaaatgtaatattggcctattttgaaatataatgtaggtaaccacactctatttattgtagcatttagtttaatctgtaatctgtactgcttgaaggtaacaaaactgaatttttacttcagtgttctgtatgattaagacgtttccagtaagccacacaggcctacctgttctatgttattccgaattagtgaggttttactgtcctagtgtcgtaaagagtttcagtcttcttgaaattataggcatttagttacggaaaggaaagtaataatgtaggtagattttgtctcacctggatgttactaaaggttaggtaaaaaaagaa

SEQ ID NO: 88472 - DNA, 414 bp, Homo sapiens
gtaaatgtgagtattgctataaagttagtaatgtttaaaaaatagcaccacaatcatcataactattaatacatttagtttttatccatgatttgccaaaataaaaattggcacatccttgaaagggagatttctaaaggaacttaagaacttctaaaagtgtctctggtgattcatttaaatgatacttacttttcctgaccttaaaactctgatttgaacttgcactccattttgtagtgatgctacctatacatattacacatgtgtgaagcctttactacagaaccaccaaaaccaggccttgaggactgtggagacacgggagctgcatctgaaggcagtcctgcatgggaattagtacctacgcctgagaaacccctctctacccagattgctctcagaattgccttt

SEQ ID NO: 88473 - DNA, 674 bp, Homo sapiens
ctctggccatgcacctgctacctacaccctggtccctgcagagggaacgactcagagtgccccttacgtgttgatttaggtgcttgccaaaatcagagattgtctgaggagtaacttaatttgagttccttcaaaataatcagtgagatggaaacttgagaacagcctcggtccgctttgggaagtagagaccgcctttcattgctcagtgggcagctgccatctgtgctgctggtgttggccatatttaccggtaggagagagggtgagagaccacagaaagtctaacgcctggaaggctccagtcgtcctgctggtaaacacagagaccccattttccagagacccactgagaggtggtgcaaagagccgaaaacacatatgcttctctgtggcttccattcttgagtgcgtaatgagtgttgtaataaagaaaagtgaaaatgaagattcagttattaataaatgttggggggaaaagacagaacctggtatttgtcctggcaggtcagcctcctagctgtgtgatgctggacggtgatttcgcttcttgaaatttcagtttccatttctgtaaaatgggaaggttgtactagaagatctccagggtctattttgaaatgaactctcccaacgttgcaatgataagcgctctcagttcatgtgcagcgttg

SEQ ID NO: 88474 - DNA, 1097 bp, Homo sapiens
gactggctgtgtgaactgataagcattctcagggtcgccccgagcggcagagtagcatctgagactcgggcagtgtggttgaggtcaccagccaagcactgggtcttgagtgcgaggaggcctgaggcttgttgtctgtcccagtcaattgccactatgtgagacctactgcatcttaaataaacgtctggagaaacccttttcctcgctgaacatgctcgtggattagcagcagcctacatctgcggcgtgtgctggtggccaggttccccgggtggtggggccttgccccaggaacttccaggagcgtgtggctaatagcaggaccccaaagaacttccaggagtgcgtggctaatgcaggacccggagaaattccaggaaagcgtggctaatagcaggaccccgagaacttccaggagagcgtggctaatgcagggacccactcgagtgggtcccctgcagagggaacgactcagagtgccccttacgtgttgatttaggtgcttgccaaaatcagagattgtctgaggagtaacttaatttgagttccttcaaaataatcagtgagatggaaacttgagaacagcctcggtccgctttgggaagtagagaccgcctttcattgctcagtgggcagctgccatctgtgctgctggtgttggccatatttaccggtaggagagagggtgagagaccacagaaagtctaacgcctggaaggctccagtcgtcctgctggtaaacacagagaccccattttccagagacccactgagaggtggtgcaaagagccgaaaacacatatgcttctctgtggcttccattcttgagtgcgtaatgagtgttgtaataaagaaaagtgaaaatgaagattcagttattaataaatgttggggggaaaagacagaacctggtatttgtcctggcaggtcagcctcctagctgtgtgatgctggacggtgatttcgcttcttgaaatttcagtttccatttctgtaaaatgggaaggttgtactagaagatctccagggtctattttgaaatgaactctcccaacgttgcaatgataagcgctctcagttcatgtgcagcgttg

SEQ ID NO: 88475 - DNA, 1891 bp, Homo sapiens
ttgcttcctttaagtgaaaatgtaaaagttcttgacaataattattttaattgtatgctgaggttgctaagatctaaaatatggcttagatctaaggtatgaacaaatcttccatccgtgaaattgtgaagaaggaaagataaattcgtgttagttttgctgtgcaccttaaacttcggaagttaccccagagtgcaggtaggcacttagttaaggtgtaaagagcattaaacttgtggatggcagacgtgaatggaaacgtgttccaactgacagccactgggtttggtactattcatggtttcaggtatccactgggggtcttggaatatactccctgcagataaggaggactactgtacccagagccaaaatactggcatatcctcaacatagcacagcccactactctcatcacaggctatgataacagatacggcatccataaaaagaggctctcaaatacaaaaatgagcaactaaataacttaaaattataactgtgaatcactaaaatatttgaagaaagtcagtaacacgaaaggccctgaacaaaccgttttaaaaagtcaaaataacagcatattaaagaagacatcaaataagtgtatttaacatcccaagagtatagagtatggtatcatagccataaaataagtataggttattataaaagaaccaatccaatcttagatattgcaattatggttgttaaagttgttttaaaagctaaatagagggatacagctgaagagtaaagctgtcagaataatcacaaggtgtctctcattcaaccaaaaagtactaacagagaaagtatcaaggaaagctcaatgatacagggatatgtcccaaaattccagtatctaaataggagataaaagatgggacatagggagaaaaatatagactagaatagctttctttggtttgaaaaggcacaagtttaggactataaaacgatctttcccttttaaataagaatcattgaccaaaagtgtcagaatatctcaacaggagtgattgtaggtgtatttttaccatagtgcactaaaatgtacatttttaaatgcaaggcttgccgaaaagaaagttttcaaatccccttctaaataactcagggcaaaaggaaatttaaaaattaaataatttagtaattaatacagaattagggctccgtggagaaattactaatatctggtcttggcaagaaataaaaggaagagtttggagcatcttgtcatactggaaagctaggaagctatcaaagattcctgagggccaaacacagtggctcatgtctaatccctgtgctttgggaggccaaggcaggaggactgcttgagctcaggagtttgaaaccaacctgagcaatatattaggttggtgcaaaagtaactgtggaaactgcaacctaaaagcaagacccctgtctatacaaaaaatcaaaaaaacaaaaacaaaaaacacaaaaaaccagcaggtgcagtagcatgtatccgtagtcctagctactcatgaggccgcggtaggaggatcacttgagccaaggagtttgaaaccagcctaagcaacataccaagaccccatctcttaaaaaaaaaaaaaaaaatcctgaggtaatatcggtaggacttagaagttaattgcaagaggctcccactggccgaagatgagacaacttgagtattaaaaaaaaaaaagaccaggcggccatggtggctcacacctgtaatctcagcactttgggaggctgaggcggggtttcaccgtgttagccaggatggtctcaatctcctgatctcgtgacccacccgcctcggcctcccaaactgctgggattacaggcatgagccaccgcacccggcctccacaaagtattcttaccaaaa

SEQ ID NO: 88476 - DNA, 286 bp, Homo sapiens
gggattacaggcatgagccactgcgcccggctgaacacatttttatgtaaacaagcagtgtgtacacttaagagtcttatgcacaggataatgtctggaaaaatgcttactgcatgtccccagctccaggaaagaggagagcttgtggggcccttccccaaacaggctgtgtcctggtcctcagtgtggctggctggaagccagggggactcagcctttgactaagaatgctccatccacccctgggaccgagaaaatctcctttcacacaattcattactcctta

SEQ ID NO: 88477 - DNA, 535 bp, Homo sapiens
aaaaactgtatggtgagagcaaataataggagggggtcttggttatgccctaatattaaacagttacacgacaacgactcatacccaaggtgttaaaaatcaatgctaatgatggaacacttcatgcggtcgttattttagaaaacccctaatcaaaacaaatgcaaggggtgaagtgtgctcagtgccagagttttgtgtgctccttagaaagacgatctattccctggagagaaaggaaaggatcagaaatgataaccacttttaaaatacatcagcttgctcatgtgtcggtgtattttttctttatcagcttttcagccaaagcttcatttgatttgtgcagggaggtgtataataggaagaggccagtgagctgatttttatagagtctgtttgtagcttaaacaaagatgggggatttggaggataaaagcggcctgaaatatagcagattatgcagctttatttttcaaagatttgttaattcccctcctccctctcctgctctctggctgagccggtgtgttttgta

SEQ ID NO: 88478 - DNA, 355 bp, Homo sapiens
cgatgagtaaatcttggccgatgagtaaatcttggtcgatgagtagatcttggccgatgagtaaatcttggtcgatgactagatcttggccatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaa

SEQ ID NO: 88479 - DNA, 458 bp, Homo sapiens
ttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaa

SEQ ID NO: 88480 - DNA, 1039 bp, Homo sapiens
caggcatgagccaccgcccctggcctccatctagactttgaaatgattgccttctaattacagtagcattctcttatttaaaatatttgttttatttaagtcagtgtttaagcaatagctcagcatatcccagtggtccagtgaccacacagctgagaacccttgttaagtggtacagtaaagcattctgtcaaaactttgacatttatgacatgttacctaggaaataggacttagaaaatgagtttgacctgggctttaaaaaagtatactgatgaaggtgccagaattgatgtccattagactgtaagctccatgggggcaggaactttgctaccgaatctatacaaccttaacattgactagtgcttgtaggtgtgctcaatacttgtttgttaactgaatcaaaaggagtaaatgcacaatatttgaacattgtatccaaaggaagaaacctgcgaaataaaattatttgcagaaatgaacatttgttgaaatgcagaaaaccactggatactgcagcctacaatattaatatgatattactcttttacagttgacacctgtcctctctgtagtctcttctctcaaatttggttcttattgagagcctgtctagtttcccaaaggttttataaaacataagttgaagtacctttatttttaattttatttttgagacaggacctcgctctgtcaccgaggctggagtgcagtggcataatcatggctcactgcagcctcgtcctcccaggctccatccatctgcccatctctccctctgagtagctgggaccacgggcacgtgccaccacacccagctaatttttgtatgtttggtagagaaagggtttcaccacattgcccaggctggtcttgaacacctgagctcaagcaatccaacctccttggcctcccagtgttaaattacaggcgtaagccaccacacccggccaagttgaagtatattttgtgatttttctgacagtgcagactgaaaaaaatttaattaacctgacaagagtttactgaatatcac

SEQ ID NO: 88481 - DNA, 496 bp, Homo sapiens
ccactaaaaactttacaagcccacactacttttgaaatgatactgtgaatacttttggtggtccaaaaaaaaaaattcatattatcaagtcagcatgacagataaattcatgtttacagctcaatagtttgagaagctcttggcagaagagctcttgctataatagttcatgtttgtttagcatgaatagtcatctagggaagactttttacattaagcaaatcttactaaaagacaaaatcagtaagctggcacatagggaaatattcataataaggtgataatgcatgtaataaaatgtgatgagtagtttcaaataaatggcagggaccttggtttgcaggcttacttagaggtctttcttgagttgtgctgatttcaccctaagccctggtgactccagctctctcttcctgtaagtcatgatgagtggacagagccttttgttcatgtgggggctaagggaggtatgtccttcatgacacctcttgcatgg

SEQ ID NO: 88482 - DNA, 324 bp, Homo sapiens
caaaaatacacacagaaatttgttgtcttgtttgttatataggtaggtatgtaatcgccccaattttgcctcttgatctacaaagcctactctctcactgttaccaggaaaaaaaaaattgtcaacccctaatctagatcaatctcagcaataccaggctctgctcagtattctagaacaagtaaaaccctggatctagaaacagacattaaaccaaactgtcaggtctcctctgggcttcaatacagcacggatcagatggttcagaaggtgttaatcagaaagcatcagaacacgaagcaaacttgaggagcatctagaaca

SEQ ID NO: 88483 - DNA, 411 bp, Homo sapiens
gaacatcacaaggagaaatgcagttgatgcaatgggagaaaacaggaagaaactcaacaattcataagagaacaagaactaaacctatgccctttgatcagaccaagtattaagattctatttcagccactaactgaaacatgagttcattcaatcttccataaatttatactgaatacagaccagaaaaatgctaaatgctattcttaataacaactaatatttattgagcactttctatgaactgggtgctgttctaagtactatatgtatgtctatacgtttatatacatatatacactaatttaatcctcacaacaatgctataaaatactaccattaggcaaaggaagttaaataactttccccttatgatacacaactaatcaatagcagagctgggattcaaac

SEQ ID NO: 88484 - DNA, 272 bp, Homo sapiens
gccaattatctatatgcaggatctatttagaatttctgacagttttactttaaataataattaaaaaaattaatttaacaatgttaacagatggtattttaatacattttaaaacatagtactatgctctttaaaatcccagccagctattagtggcaaattcaatggcaaacttagataacttcaattaaactttagtaacttttctaacaactactgattctgttccctgcataataatggacttagcaaccataaggtaatacagtgat

SEQ ID NO: 88485 - DNA, 352 bp, Homo sapiens
ccaattccggacaccctttgatttccagtctgttctttgcctgccatttgggttcactgattctgggttgtagagctccccagtatctactttgcgttgtctcatcaatcagaattcaatctctgcttgtctctgtacttcctcctagcttccggagctaggtttattcttctgttacctttacccattcaacaaagaggaggcggaattgttgaaactatctttaggtcctgattcctccaggccagccttgtaccactgtagccaggtagaacatacgggttatctctgcggtagctccaatcttttcacatacctgtctttcctccttatcacttttctaaatttaaat

SEQ ID NO: 88486 - DNA, 776 bp, Homo sapiens
tattttatcataactatattacccgccaatgcttcaccagttacagtaatttttttggagacagagtttcgctcttgtcgcctaggctggagtgcaatggtgtgatcttggctcactgcaacctccaactcctggtttcaagcgattctcctgcctcagcctcctgagtagctgggattacaggcatgtgccaccatgcccagctaattttgtatttttaggagagatggggtttcatcatgttggtcaggctggtcttgaactcctgacctcaggtgttctgcccgcgttggcctcccaaagtgttgggattacaggcgtgagccatcacgcccggctaattttgtatttttaggagagatggggtttcaccatgttggtcaggccggtctcgaactgctaacctcagatgatctgcccgcctcagcctcccaaagtgttgggattacaggcgtgagccaccacgcccagccgggttacagtaatctgagagcaataaaagtcaaagcaggctggatgtcactctgttatccaagataggaaagagaatcgatatgccttggtcccaattccagttttgttggttctttcgttattctgggctttgctgctacagccattatcaaatggagacacctcgtgtccttgtctacctcccagtgttcttgggtagatgaacaggatgtcaaaacattcatcttgagactgtagaagcctgtactattgcattggggctaatctcatgttccacctttgactggcttggtttttcttgg

SEQ ID NO: 88487 - DNA, 1325 bp, Homo sapiens
atatgaggccacacagcacaaccatactaacatttaggatgtcatagagaagtcacgaaattaccaagaactatggtgaactaattactccaaaccctagggctgtgactacctcttgggagaggacagcacggcgccacggttagcagtgtcaggttttgtgacctgggggtgctgtgactcaggattctccctgctggttatgtggctgtcctgtgtgtcagacaccgtgtgcatgtctcacgtagtctgcagtcgacaaaacaggcctgatgcagaggccactgtgtctcgggtgcaggtggtgtggggagggacaaagccaggtcacactgggcctgggaccttagagagcagcgtgagctctgtgcccatgctgcaagaacctgtggaagctgtgcagtggtttggattggatttcttccttgaatggcttggagcaggaatgtggttgatgttcttgagcattctattccagctgctgtgtccagaaggggctgggggacagggtcacacatgcactaatggaaacaggattagtgattgtcagagttaggaggggacagcagaggcagaaggtaacatcacaaactcagggcttgaccagctagggacagggaaagagaatttggattctgggagatgacacagtcagcccttccagtttaggggagtgaggggatcagtctcatagaggctgcaaggcaagaacgctgttgggcattcacgaatgtttgtggttgaataaacaagccacagtttaagcaaccataattaaacctaatggatgggtgacagtaataaccattttcaggtttcattcaagtttagagacaaataagtaagtaagtaagagacagggttttgccacattgcccaggctggtctggaactctggagctcagaggattctcaaaccttccagagtgctgggattgcaggaatgagccaccacacctggtccagtgtttcaattttgcttacaaaagtatactttaggccgggcgcagtggctcgcacctgtaatcccagcactttgggaggccaaggcaggaggatcacgaggtcaggagatcgagaccatcctggctaacacggtgaaaccccacctctactaaaaatacaaaaaaattagccgggtgtggtggcaggtgcctgtagtcccagctagtcaggaggctgaggcaggagaatggcgtgaatccaggaggcggaagttgcagtgagccaacatcacgccactgcactccagcctgggcaacagagcgagactctgtctcaaaccaaaaaacagtatcctttaggccaggcacggtggctcatgc

SEQ ID NO: 88488 - DNA, 6243 bp, Homo sapiens
  misc_feature (576)..(576): n is a, c, g, or t
  misc_feature (5848)..(5850): n is a, c, g, or t
  misc_feature (5910)..(5910): n is a, c, g, or t
  misc_feature (5928)..(5928): n is a, c, g, or t
  misc_feature (6243)..(6243): n is a, c, g, or t
tttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattggcattgctgtcatcctcgtgggcacttccgacgaggtggccatcaaggatgcccacgagaaagatgatttccaccatctctccgtggtaccccgggtggaactggtagccatgaatgagaccgacccaaagagcatcatcacccgcatctgtgatctcatgtctgaccggaagatccagggggtggtgtttgctgatgacacagaccaggaagccatcgcccagatcctcgatttcatttcagcacagactctcaccccnatcctgggcatccacgggggctcctctatgataatggcagataaggatgaatcctccatgttcttccagtttggcccatcaattgaacagcaagcttccgtaatgctcaacatcatggaagaatatgactggtacatcttttctatcgtcaccacctatttccctggctaccaggactttgtaaacaagatccgcagcaccattgagaatagctttgtgggctgggagctagaggaggtcctcctactggacatgtccctggacgatggagattctaagatccagaatcagctcaagaaacttcaaagccccatcattcttctttactgtaccaaggaagaagccacctacatctttgaagtggccaactcagtagggctgactggctatggctacacgtggatcgtgcccagtctggtggcaggggatacagacacagtgcctgcggagttccccactgggctcatctctgtatcatatgatgaatgggactatggcctccccgccagagtgagagatggaattgccataatcaccactgctgcttctgacatgctgtctgagcacagcttcatccctgagcccaaaagcagttgttacaacacccacgagaagagaatctaccagtccaatatgctaaataggtatctgatcaatgtcacttttgaggggaggaatttgtccttcagtgaagatggctaccagatgcacccgaaactggtgataattcttctgaacaaggagaggaagtgggaaagggtggggaagtggaaagacaagtccctgcagatgaagtactatgtgtggccccgaatgtgtccagagactgaagagcaggaggatgaccatctgagcattgtgaccctggaggaggcaccatttgtcattgtggaaagtgtggaccctctgagtggaacctgcatgaggaacacagtcccctgccaaaaacgcatagtcactgagaataaaacagacgaggagccgggttacatcaaaaaatgctgcaaggggttctgtattgacatccttaagaaaatttctaaatctgtgaagttcacctatgacctttacctggttaccaatggcaagcatgggaagaaaatcaatggaacctggaatggtatgattggagaggtggtcatgaagagggcctacatggcagtgggctcactcaccatcaatgaggaacgatcggaggtggtcgacttctctgtgcccttcatagagacaggcatcagtgtcatggtgtcacgcagcaatgggactgtctcaccttctgccttcttagagccattcagcgctgacgtatgggtgatgatgtttgtgatgctgctcatcgtctcagccgtggctgtctttgtctttgagtacttcagccctgtgggttataacaggtgcctcgctgatggcagagagcctggtggaccctctttcaccatcggcaaagctatttggttgctctggggtctggtgtttaacaactccgtacctgtgcagaacccaaaggggaccacctccaagatcatggtgtcagtgtgggccttctttgctgtcatcttcctggccagctacactgccaacttagctgccttcatgatccaagaggaatatgtggaccaggtttctggcctgagcgacaaaaagttccagagacctaatgacttctcaccccctttccgctttgggaccgtgcccaacggcagcacagagagaaatattcgcaataactatgcagaaatgcatgcctacatgggaaagttcaaccagaggggtgtagatgatgcattgctctccctgaaaacagggaaactggatgccttcatctatgatgcagcagtgctgaactatatggcaggcagagatgaaggctgcaagctggtgaccattggcagtgggaaggtctttgcttccactggctatggcattgccatccaaaaagattctgggtggaagcgccaggtggaccttgctatcctgcagctctttggagatggggagatggaagaactggaagctctctggctcactggcatttgtcacaatgagaagaatgaggtcatgagcagccagctggacattgacaacatggcaggggtcttctacatgttgggggcggccatggctctcagcctcatcaccttcatctgcgaacaccttttctattggcagttccgacattgctttatgggtgtctgttctggcaagcctggcatggtcttctccatcagcagaggtatctacagctgcatccatggggtggcgatcgaggagcgccagtctgtaatgaactcccccaccgcaaccatgaacaacacacactccaacatcctgcgcctgctgcgcacggccaagaacatggctaacctgtctggtgtgaatggctcaccgcagagcgccctggacttcatccgacgggagtcatccgtctatgacatctcagagcaccgccgcagcttcacgcattctgactgcaaatcctacaacaacccgccctgtgaggagaacctcttcagtgactacatcagtgaggtagagagaacgttcgggaacctgcagctgaaggacagcaacgtgtaccaagatcactaccaccatcaccaccggccccatagtattggcagtgccagctccatcgatgggctctacgactgtgacaacccacccttcaccacccagtccaggtccatcagcaagaagcccctggacatcggcctcccctcctccaagcacagccagctcagtgacctgtacggcaaattctccttcaagagcgaccgctacagtggccacgacgacttgatccgctccgatgtctctgacatctcaacccacaccgtcacctatgggaacatcgagggcaatgccgccaagaggcgtaagcagcaatataaggacagcctgaagaagcggcctgcctcggccaagtcccgcagggagtttgacgagatcgagctggcctaccgtcgccgaccgccccgctcccctgaccacaagcgctacttcagggacaaggaagggctacgggacttctacctggaccagttccgaacaaaggagaactcaccccactgggagcacgtagacctgaccgacatctacaaggagcggagtgatgactttaagcgcgactccgtcagcggaggagggccctgtaccaacaggtctcacatcaagcacgggacgggcgacaaacacggcgtggtcagcggggtacctgcaccttgggagaagaacctgaccaacgtggagtgggaggaccggtccgggggcaacttctgccgcagctgtccctccaagctgcacaactactccacgacggtgacgggtcagaactcgggcaggcaggcgtgcatccggtgtgaggcttgcaagaaagcaggcaacctgtatgacatcagtgaggacaactccctgcaggaactggaccagccggctgccccagtggcggtgacgtcaaacgcctccaccactaagtaccctcagagcccgactaattccaaggcccagaagaagaaccggaacaaactgcgccggcagcactcctacgacaccttcgtggacctgcagaaggaagaagccgccctggccccgcgcagcgtaagcctgaaagacaagggccgattcatggatgggagcccctacgcccacatgtttgagatgtcagctggcgagagcacctttgccaacaacaagtcctcagtgcccactgccggacatcaccaccacaacaaccccggcggcgggtacatgctcagcaagtcgctctaccctgaccgggtcacgcaaaaccctttcatccccacttttggggacgaccagtgcttgctccatggcagcaaatcctacttcttcaggcagcccacggtggcgggggcgtcgaaagccaggccggacttccgggcccttgtcaccaacaagccggtggtctcggcccttcatggggccgtgccagcccgtttccagaaggacatctgtatagggaaccagtccaacccctgtgtgcctaacaacaaaaaccccagggctttcaatggctccagcaatgggcatgtttatgagaaactttctagtattgagtctgatgtctgagtgagggaacagagaggttaaggtgggtacgggagggtaaggctgtgggtcgcgtgatgcgcatgtcacggagggtgacgggggtgaacttggttcccatttgctcctttcttgttttaatttatttatgggatcctggagttctggttcctactgggggcaaccctggtgaccagcaccatctctcctccttttcacagttctctccttcttccccccgctgtcagccattcctgttcccatgagatgatgccatgggccctctcagcaggggagggtagagcggagaaaggaagggctgcatgcgggcttcctcctggtgtggaagagctccttgatatcctctttgagtgaagctgggagaaccaaaaagaggctatgtgagcacaaaggtagcttttcccaaactgatcttttcatttaggtgaggaagcaaaagcatctatgtgagaccatttagcacactgcttgtgaaaggaaagaggctctggctaaattcatgctgcttagatgacatctgtctaggaatcatgtgccaagcagaggttgggaggccatttgtgtttatatataagccaaaaaatgcttgcttcaaccccatgagactcgatagtggtggtgaacagaacaaaaggtcattggtggcagagtggattcttgaacaaactggaaagtacgttatgatagtgtcccacggtgccttggggacaagagcaggtggattgtgcgtgcatgtgtgttcatgcacacttgcacccatgtgtagtcaggtgcctcaagagaaggcaaccttgactctttctattgtttctttcaatatccccaagcagtgtgattgtttggcttatatacagacagagatggccatgtattacctgaattttggctgtgtctcccttcatccttctggaataaggagaatgaaaattcttgataaagaagattctgtggtctaaacaaaaaaaggcggtgagcaatcctgcaagagcaaggtacataaacaagtcctcagtggttggcaactgtttcaacctgtttgaaccaagaaccttccaggaaggctaaagggaaaccgaatttcacagccatgattcttttgcccacacttgggagcgaaaagattctacaaagctcttttgagcatttagactctcgactggccaaggtttggggaagaacgaannnacctttgaagaagtaaggagtcgtgtatggtagggtaagtgagagagggggatgtttccnatgctttgatcccttctnacttaacctgaagctagacgagcaggcttcttccccccaaaactgattacaactgctacagagcagacagttaagagaaatgagcttgacatttaagagaaatgagctgcactccatgagtgcagctctggaggtacgaaaagaggggaagagacttggaaatgggagacgggggcagagagggaccctccaccacctctttgggcctggctgggtgggaatgtgacttgagcccagagtgaacactcttggtagaagcccttctaccttcctgcaacacctgttccctctcagattgtaccattgagccggaan

SEQ ID NO: 88489 - DNA, 360 bp, Homo sapiens
tccaatgattagaagggacagtaaccttctccattctgttcctttcccttcaactgtcactacagtgtcacctaggagcactctgtcactctggtttgatgttacaatacagcatagtatgtacagtttggtctcagtcatactgaagtttggctagttttctagaattatctttacaaataatagcctgtgcttatgtttccaagttaatagtctggcttttactgcctaattaaatgaaaagggcttaaaattcacaagactcacctcttcaattacttttctatttgtagtgtgatcattttagcagaaattaaattagttagaaacctaactaaaataaatgcaagcttcacacag

SEQ ID NO: 88490 - DNA, 157 bp, Homo sapiens
cacacaaatagcagtcaataaatgttgtctatttttaattttttattccatacacctatctagcttagaaacaatcattagccattatgcctaacatgacataaataataactaacatatattaatacttgatcctcccatgaccaaacatttttgg

SEQ ID NO: 88491 - DNA, 303 bp, Homo sapiens
tatgctagtctcaaaatggcataatgctttaaagagagtagtttaatccattagatggtaaatttagttaatcttcttcgaaacagctaggttttcaatggtttgctcctcccgttaagactaatttttgctttagttttattcttcagagctcgaattattatttgtgcaagatttttaatgtaacttgagtactaaggacagcagttaattatctgaaactaatttgtaacagttttgtaagctactgtgaccgaatgttatttcagttacagtaataaattaacaacttgttggataaag

SEQ ID NO: 88492 - DNA, 921 bp, Homo sapiens
gggagaagtggccctggacgggcagaagccgcagcctgaaaagacccaggaagaggaaaagaggagtaccgcgccggagccttccgcagctgccgcttcagtccgaaggaggaagggaaccaacccactttctcggcgccgcggctcttctctaaaagtgattacttccttaggatagattgccagaagtggagttactgggtcagaggaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaagtgagtatattcaatatattgttaacctgagaaactttacatatctattttaattgtaatgaaactttcctcacagtctttgtattactaaaaattaatcttaagatgtgtaataataaaatgaactagttttttgtcttac

SEQ ID NO: 88493 - DNA, 605 bp, Homo sapiens
ctcagcccggggctgcactgcaccctgggcaattcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgttaaaaaaaaaaaaaaaaaaaaaaaaaaagggcggccgctcccaccaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88494 - DNA, 2079 bp, Homo sapiens
agtcaaggctttgacagggcatagtctcctccaataatcttctccgttctctctcattattccctcgagttcttctcagtcaagctgcatgtatgtatgtgtgtcccgagaagcggtttgatactgagctgcatttgcctttactgtggagttttgttgccggttctgctccctaatcttccttttctgacgtgcctgagcatgtccacattagaatctgtgacatacctacctgaaaaaggtttatattgtcagagactgccaagcagccggacacacgggggcacagaatcactgaaggggaaaaatacagaaaatatgggtttctacggcacattaaaaatgattttttacaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaaaaagtcgacgcggccgcgaattta

SEQ ID NO: 88495 - DNA, 3992 bp, Homo sapiens
tcccctcccctggcagcgcggaagagacccgggttgccgcctggtttagcgacacgagcaccgcttcttcctcagtaccgcgccggagccttccgcagctgccgcttcagtccgaaggaggaagggaaccaacccactttctcggcgccgcggctcttctctaaaagtaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88496 - DNA, 4033 bp, Homo sapiens
gggagaagtggccctggacgggcagaagccgcagcctgaaaagacccaggaagaggaaaagaggagtaccgcgccggagccttccgcagctgccgcttcagtccgaaggaggaagggaaccaacccactttctcggcgccgcggctcttctctaaaagtgattacttccttaggatagattgccagaagtggagttactgggtcagaggaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88497 - DNA, 3146 bp, Homo sapiens
attttcatgaattaagtaattgccacctaaaaaataacagaagagagtatgaaaacatataaatattccaagtcagatgttaaaattttttaaagcagctttatatttccatagtgtaatattagtttgggatttattacagggctttaatgtctgtctttacttgtctagaagtagcttcactggctcctaactactgccctggggcagattcagatgaaatgtggtatgtagccacacccaatactgttggcatactttcattgaatctattcccatggaagaaacccagttgcaatttcagtattatttcatcaaagaggccaggccagagctatcataactgctttcatgtcgtgtttcctttttattatatcatgttttatatcatatgtttgctttctacatactacatacacaattgcttgtgcttatataaatttataatgcttttgaataaacaaaacaataaatagtgatgggatcattttatacggatgtaatattttctgaagagccaaacaaattaaataagtaactttactccaaattttaatgagctattaaattttatttaaatcacttttcctttctacccaaaagtaatcatcttaagtgtttttccagtgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88498 - DNA, 2227 bp, Homo sapiens
gcagaaggtatgaagttgcactatctacatcctcaccaaggaatgctgtcgttcacacagccagaaaataagatgtttgtctggtagctaaccaagcttcttggaagacagacctcttgaaagttaatgtttcagttacaaatcactaccagattttcttacatccatgctgatcctaaaatactgaggacatgggtttctaaatatgtatcatttcaaatgttgcatttattgtatgttctaaagtagaagtctacaaattataatgtaactaactcatagccattatttctaaccagtaattaaattcttttggtttttgtctaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88499 - DNA, 3580 bp, Homo sapiens
  misc_feature (266)..(266): n is a, c, g, or t
ctcagcaggtcaggacatttggtaggggaaggttgaaagacaaaagcagcaggccttgggttctcagccttttaaaaactattattaaatatatatttttaaaatttagtggttagagcttttagtaatgtgcctgtattacatgtagagagtattcgtcaaccaagaggagttttaaaatgtcaaaaccgggaaaacctactctaaaccatggcttggttcctgttgatcttaaaagtgcaaaagagcctctaccacatcaaacngtgatgaagatatttagcattagcatcattgcccaaggcctccctttttgtcgaagacggatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88500 - DNA, 3611 bp, Homo sapiens
agtcaaggctttgacagggcatagtctcctccaataatcttctccgttctctctcattattccctcgagttcttctcagtcaagctgcatgtatgtatgtgtgtcccgagaagcggtttgatactgagctgcatttgcctttactgtggagttttgttgccggttctgctccctaatcttccttttctgacgtgcctgagcatgtccacattagaatctgtgacatacctacctgaaaaaggtttatattgtcagagactgccaagcagccggacacacgggggcacagaatcactgaaggggaaaaatacagaaaatatgggtttctacggcacattaaaaatgattttttacaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88501 - DNA, 3961 bp, Homo sapiens
tcccatttcacctgcccattctatacaaaaacaacaaaaggaatctcaaccaccagcaggattttaaaaaggctatctaaatatttggattacttccttaggatagattgccagaagtggagttactgggtcagaggaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88502 - DNA, 2383 bp, Homo sapiens
ggcaggtacagcctgggtgtgaatcggcgaggattcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaagcct

SEQ ID NO: 88503 - DNA, 1267 bp, Homo sapiens
agtcaaggctttgacagggcatagtctcctccaataatcttctccgttctctctcattattccctcgagttcttctcagtcaagctgcatgtatgtatgtgtgtcccgagaagcggtttgatactgagctgcatttgcctttactgtggagttttgttgccggttctgctccctaatcttccttttctgacgtgcctgagcatgtccacattagaatctgtgacatacctacctgaaaaaggtttatattgtcagagactgccaagcagccggacacacgggggcacagaatcactgaaggggaaaaatacagaaaatatgggtttctacggcacattaaaaatgattttttacaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatccgctgagcggacatttgcgttcaggagttcgagaccagcctggccaaacatggtgaaacactgtctctactaaaaatacaaattttagccaggcaaaaattagtggtggacatgcctgtagtcccaactatttgggggctcaggcaggagaccgcttgacctccgcctcctgg

SEQ ID NO: 88504 - DNA, 2304 bp, Homo sapiens
  misc_feature (25)..(25): n is a, c, g, or t
  misc_feature (93)..(93): n is a, c, g, or t
  misc_feature (124)..(124): n is a, c, g, or t
  misc_feature (687)..(687): n is a, c, g, or t
gatgtttaactccaatcaccatgcntattttccagggctctgtttggactaaggtttaccgtatatgcaaaagagaaaaaaaatgctctctgnactccaactgccttctgcagaggatgagtcntgttagactacagagtttctcaaagaataagctgaagatccctctaacagaatcaaatcatgactattaaaaatacatattcctcagccaaccccaaacctgataaaccagcatctgaaattttaacaagatttgcagatggttctcatggacccttatgataaccatgggctgaaagggagcagtctcaggtggtcctttggtttatgaggggtaccttgattggtttcagatgtgcaatgataggtctgaagaagggcttgggagtaaggctggaaagagcagatatgctctatatgatcgaggaagaagaaaataaaattctggggacatacggtaaaaagaaatttgaaaggaaagatggaagagaaggaaaaaagagccatcttgatggccagaggttgaatactggtagaacacgctttaagaaatcttgaaggggagggtggttgagagggcttttcaagaatagggccctctgctgttaaatcaaagttgtttgtgctgaatgaatatctacttctggaattctttttgtctctccagacatccagtagaatccnctacacatacagaggcttttatgattgggttgagtttttatttgcagaaatcaaggcaagaaggtgaacttcatttctgaacccacacacagtacagaatagagacaatatcagggaaaaaaaatcataaacgaccaaaaaaggaaaaacaaacaaacaaaacattcacaggagcagaaacttaagcacaaggacccatgtccctgaaaagttataaaaatctttggattgagcctgagactatgtatggaatggaagcttgaccaatctacttaaattttaagagcaaagtgctcccagatgccatgtgggttatatgaagtcatatgatcttttccttctactactcaacaaaacaaacaaaaaacaaataaaatgaccttctacatattcaaactcttgtgcttaggagaaatttggctttgtatttgtttttaaaatttgctttattagaatcttttttccaaggcagtgattatttctaacatctctctttagaggtgtagtacttacagttagacacctttttaagctgaggaccacataaaataatagggtgacatctttttcagggactaaattgagccctgacaacctacaaaaggggacccacttcccacaaatgagtaaagtattttacccatgacagatgcaggcccccagctgctccacaagcatatttaggccaagtctactgtttccattcactgcccctttaattagaggtttcttaattgatttttaaataagaatttggttattatctgtgtgggaaaaatgatgcactttattgttcaactactaagatacatagtagtaatgctgcttttggttacaattttttttaacatgagaatggaataaacttcagagaatatttggtaaaggagaacttaaagctaagaagttgcaatttttcacccagtttcaaatttgttctcttaacttttaacagattgttttccatacgcctcagtttcctcattgtgaaatgggagttgtaacaaatctgtctgtgaggatggtgaccatttggtagacccttacctttcaaaaggaatatttcctgagacatattcctcaaaaaggaatgtttaggatcctggttttctcctggatcacatctctgaggagaatcacatttcctgtgtgtttccttcagctagagctataataccttgaactaaaatctcctcttttgcacctaatggctattttcatcaaagaaagactttttctctcttaaggatggactgcaaaataaaaccagttgaggtcttgatgctgtgcactaggctaaggctcacctgtgagtaagtgtctcaccaagtctgactgacgtgtattttttaattcacacaccagccctgcccaccaatatctggtgcacagcagagggcatgtgggtatttaataaacacaggttgatgcatggattgctggcctctggacccacaggaaggtgtgggtatcattttcttctcacttttcatgcatacaaaaatgacccagaggttcttaaactaggtttctgtgatgatctcatgaaggatgatgctatagaacattacgggaatcagaagaccctccatgtcaactgtctttgtaggtctacag

SEQ ID NO: 88505 - DNA, 766 bp, Homo sapiens
catatatctgataagggattaatattcagaatatatagagaactcctaagactaaacaacaaagaaacaatccaattcgaagaatggacaaaaaatcaaatagaaatgtctcaagagaagatacacaaacatccaatatatacatgaaaagatgctcaataacattaataattagggaaatgcaaatcaaaactgtgaggctcaagtcatcccacagggcttctaaaggaaaagagggtccaaaaatccagatggctagagcttctctgggcttgcatgaggagcaacctcacattgattaagatgtgagcttttatgctgtcctgtgatcaaataacccacctcaccatgctatcttacttctgcgtttccaatttaccataatactcccaaaataaccccttttataaggggtcattttaattgtctgagttccctcttaataacagggaagaaacaaaattttaaccacttcttaccaatgcatgaatgactaatattgtctcaaatgtgttatctctttagttcacccaattcaaagccatgtttggagatttctgtatccagaagcagagtctgaaagaaataagtctcccataatggaaactgaagaacaaggacaaatttttgagagtgataatttggaaaaagaatgtattttagcactccacacaatataacacaggcatgcttgtcagcatgcttcatttttaaactaactctgatagaagatgttttctgattgtgactcattatttgttggatg

SEQ ID NO: 88506 - DNA, 573 bp, Homo sapiens
ccatactatgcggccctccacccaagagcattgtttgtgcaggtaggatctgcagtgtggatggagggtaatggaaaattgtggccactgttagctggtcagactgatatttactgtatgtcaggtactgtgctgagtccttcatgggtatcatttcgtttggtccttgcaataaccctatagggcaggtcctattattagatgcattttttagctggaggtgatcacactgctgaaaagtgacaaccagattcaaatgcagagtttctgactactgtgatatagggtcccggatggcacgtgcttaccagcagccaaagagagtccatttggccttggaatttctaactcagagactgaaacacagagggacttgtaggtggaaccaaggtttaaatgacttaattggatgggcttacctttggaggaacaccatagaagcaaatgtgtttttcaaagatcttccactagatgtcaccaaaaggactgagaactagagaaaagggctgcgatttctgctctccttgtaagattgcacaaaagaataaattgcatttatcgctgtttgcaaaa

SEQ ID NO: 88507 - DNA, 252 bp, Homo sapiens
gaatgggattcttcctttcccatcctctcccccacaggccattccttttggttcccccacacatccttgggtttcctagagatgatcgaggtcagagtgtgtgcggaggctatgggaatgggaaggaaaatttcagatcctctgtcagttagaggtaaagaaaggagagaaaaggattgaaaacagcttccaaagcagtgactggaacagggaagaaagtgggagctggagtgagattggtgaggaagatga

SEQ ID NO: 88508 - DNA, 327 bp, Homo sapiens
gacttttggggtgtggagggcaaggggagggaacttagaggacaggtcaataggtgcagcaaaccatcatggcacatgtatacctatgtaacaaatctgcatgttctgttcatgtatcccattttttaatgaagatgtaaagaaaaacaaaaattaaaaaaagaaatttgtcataaggaaaaaaatgaagaaattagcagtacaaatcacaaaagcaaaaatggactgtgcagttggtattttctaagtgctctgtatgttaatgttttctaagtacttggtattgttaaccctataatgaaagtacctttttaatacttttaattc

SEQ ID NO: 88509 - DNA, 172 bp, Homo sapiens
actctgtctcataaataaataaatattaaaaaaaaagatttggaaagagaatcagctgacctgtaattgagcattcccttttggttttcttctgttgcttagaagaaaaaagttttaaaggctttacaaaattataaatctgtacaaaaactggaaaacatgattcccacgt

SEQ ID NO: 88510 - DNA, 491 bp, Homo sapiens
tacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccaaaaa

SEQ ID NO: 88511 - DNA, 370 bp, Homo sapiens
agaaaaaactaagatacagaagaatgtgtatagtataatgtgatttaggtatgttttaaaaagaaatatatttatgttggtatatgcattactttttttcctgaaaggatatacaaaaaactgttgatagtggttacctttgggtggatggaggacatttggaactttttgttttagacatttctccagtgttttaatttttctgtgttcatgtgttactttttgttgtttgtttgagacagggtcttgctctgttgcccaggctagagtgcagtggcaccatcatagctcactgaagcctcaaccttccaggctcaagcgatcctctcatctcagcctcttgaatagctgggaccacaggcatgcacca

SEQ ID NO: 88512 - DNA, 522 bp, Homo sapiens
ggctctgtccactctgccacttttttcctctgctcctcacaggatcatttccattgtaagtgtctccagcttgctgattctttattctgcctgctcagatctgccggtgaacccctctagtgaatttgtaagtgtcagttattattttcagctcttctagttccatttgatcaccttcataattcctatctgttgatatcctcattgtgttcctctgtgattttcctgacttcctgtagttctgtgtccatggcttccttcagttcttcgagcacatttaagacagtcggtttaaagcctttgtttactaagtccaatgtctaggcttccttgggcatgtttttgtcagttaaatattttcctttgaatgagtcataccttcctgttttatttgctttagattttaggtcactaaatttttctttgtgtctaaactgctgttaaacctatccattcagtttttaatttgggttattgtgtttttcagttgaatttttttttaaccgtatctcctgtatcttt

SEQ ID NO: 88513 - DNA, 391 bp, Homo sapiens
aataaaaaagttcttaaaaaatccccccaaaatctcataatgttttaagaaagtttacaaatttgtgttgggccgcattcagagctgtcctgggctgtgggttagacaagcttgctttatagcctaggagcaacaggcccatgtagcccaggtgtgtagtgggctatgccatctaggtttgtgtaagtacactgtgatgttcatacaacaacgaaattgcgtaatgacacatttctcagaatgtatccctactgttaatcaactcatgactggattgttctctattctgttccatgacatgatttctataaaataaaaactctttgagaaattagaatattattattaagctgtaaggaaccatttgaaaaataaattgctgatttttgct

SEQ ID NO: 88514 - DNA, 302 bp, Homo sapiens
tccaaacactcatcaagctcaagtctctcccaaccaaaaacctggccttcctcatgagccgtcttccttccctccccagcttggcttctccagggtgtctcccattctcttgcgtcctctccttcctcacttccaccatcaccaccatcacgcctcctatgaaccatgagattggtattatcaagaccccacagatacagagaggctgagcgtcttacggaggagaggtacctcagagctggtacagacagaagcccaggaggtctaagtccaatgtgcccactccttaccacctttttacc

SEQ ID NO: 88515 - DNA, 601 bp, Homo sapiens
tttgtctggcttctaatacacaaacagttgtccttatgatgtaaatgtggagaaaaccaacagatgacagcaaaatttacctgaaaatgaagcaaagaaatgaggagtttaaaagacagagaagaactgcctttaatcaaatgcttggagattttgaacttcttatattttgattaccaatgtactttttttttcaaatgtataaaggtactggattttcctagccctttctgtttatttcatgttcctatccataaaaaataaaaagtggtttgactattttcaaggcataaaagaaaaacaactattacctttaagcatatactgtagcattaaacacatattgtctcttttcaattctaggcctaagttaggagttctttcttgttacttctatgagatctgatgcatttatatttcatgatacttatgaaaaaatattttcaatgcctatttacttatctttctccttcaagagttatttgagggcatgagctatatcttttcaacatcatatccctaatgtctttctcaatagttggtacatggtaggcactcaacagatatgttttagaattaactaattaattgtggaattata

SEQ ID NO: 88516 - DNA, 949 bp, Homo sapiens
ccggaggacgcgctgctgcgagaccagccgcggcgtctttggcagtagtgggcgtgcttgcgggtccaggagggcccctctcccgcgaccgccgaccacgatgagagcgtgaagaccctctcgaaaggaagggctctgctctacacactggtgtctcctgcggaagggcagctgggcacgccttccagaccgagcaaaagtgaaaaatcagtaacccaagatgactaaccaaatcaatatgctgggcaggatgagacatcagtgtctgcctcagacagaagagcacacacaaaacatgacctctcactccaagcccagttacagcagaaagttttcatggagaaatggaatcacacttcaaatgatttcattttgtcgggtctgcttcccccaaatcaaactggaatatttctcttgtgccttatcatcctcatattctttctggcctcggtgggtaactcggccatgattcacctcatccacgtggatcctcgtctccacacaccgatgtactttcttctcagccagctctcccttatggacctgatgtacatctccaccaccgtccccaagatggcgtacaacttcctgtccggccagaaaggcatctccttcctgggatgtggtgtgcaaagcttcttcttcctgaccatggcgtgttctgaaggcttactcctgacctccatgggctacgaccgttatttggccatctggccactctctctattatcctatccgcatgagtaaaactgatgtgtgtgacgcatgcatgcgacggctcttggcacaatgggggtccatctaatcccttggcacacaccaagtcttgtcccttccgtgtacccctaatggcaggtctacgggctataggaaccacttattcttgcgaatgtcccagccatagttgactcattgcctggtaccaacttctgaggtcacgacactacca

SEQ ID NO: 88517 - DNA, 366 bp, Homo sapiens
cctgccccagactcccaaagtactgcgattacaggtgtgagccaccacacctggccaataatgaatattttctaacttaattcatgctgcttttcaacttatgatactaccagaagtgtatgcttgtatcagttgcatacaattgcccctgaggcattttaaaaatttaattcttctgcatgtgtgacggtggtgtgcagtgctggtatcttttaatttgcgctcttggccttgtatactctttatttctgtctagcatttaaaaaaaaatcagcttttgtattaccaactttttgttctttttgtcatgcgagtcaaaacatatttgactttctctgagtattaaaagaaacaacccaacaacaa

SEQ ID NO: 88518 - DNA, 314 bp, Homo sapiens
gatcattgcagtctctggctttttgactccaggcgggctccgtgccctccggggcctcttcttccttgtcaggccagtgggagccacagaggcctcattggcttcctatgaatattaaatgggattctctgtgggggaagcttccataaggcaggaaggggtccccggttgttggctattagtgttattttcttttaaatcatctgtgctccttcaaagacgacgtaagaagcttgtgccctggcgttgcagaaatctctggctgtagggattaaacctacatgtcttcctgatggggtggtgaggacgtaaac

SEQ ID NO: 88519 - DNA, 345 bp, Homo sapiens
aaatatatgtggccaggtgtggtagctcatgcctataataccagcactgtgagaggctgaggtgggagaattgcttgaggccagcaatcagaaccagcctgggcaacctatagcaagaccctatcttcatttaaattaataataataataataaacaaaacaattgtcaaagatacgtgcctttgattattctagtctctatttgcaacaatagtctttcactagagcaaacaactctttttcttttttttctttttttttaagacaggttctccctctgtcacccaggctggagtgcagtggctcgacgtcactgtaacctccacctcgcgggttaaagtgatt

SEQ ID NO: 88520 - DNA, 567 bp, Homo sapiens
gaagaccttgagctgtgtggaaggattgccctctggtgttcaagtgattgcactaccgcactgcaccttatgtgcctctgtctcaggcaaggtgcattaagacactatgtaaagttacaagaaaaagcaccttgtttagctgcctatcaggttaacattggtgttgaaatcatcgttcctaacagtgttatgttaagttacagggacgtttcgaggtattgatatatgtgccaaactcttttctttttgttaacattgatcatgtgacaatttgcaagtgtagatgtagctgagtgctgtgaacatatttgacatgaattcaggtaatgtactaagatttttgttcggtaacactaaatcccgtatgagtgctaaatactgaattgtttaatatgagagaaattatttggtttttaatgttgcgcgtttctgggatttagggcttcaatatgtttaggtattattgttatttaattgatgtggaagataagtcttcttaactgaagactagctcaactgttttaagaactcagagtagctctatagggtgcatacttttcaccaact

SEQ ID NO: 88521 - DNA, 403 bp, Homo sapiens
aaatgtttgtgtggcatgtgaagggcagggagagggcagggagagaaagcaaatacagcaaatgtctacagtgaaaccaggtgaaaagtatatgagcgttcactgtattatttcagcttttctataattcccaagacatttctaaaataaaaatttgcgaggaaaagtaaccagtgttagtaagggtatatacactaacgatggatgtgtaagttgctcttacaatttgcttaaaggacaattgggagattttctcaagggttttgaaatactgcctgtagtttgataatattcaaatcctaagagtttattcaaaggaaataataaggccgggtgtggtgactcacacctgtaatcccagcactttgggaggctcaggcaggcagatcacaaggccaagaga

SEQ ID NO: 88522 - DNA, 109 bp, Homo sapiens
taaatgaatgaattaatgaattaattaaataactgctacatagtcctctgtctcaccttttccctagacataggtctacttcctaaagcaactacttttacccattgct

SEQ ID NO: 88523 - DNA, 236 bp, Homo sapiens
atttggtaatcaataccctcagaaggaacagtactctcacgacaggcatgattatcttactgttctgtcactagtaaatgtttccaaatagctgcaattttagacaatctcttttttttttttccccatatagagggggtttggacttgtggcccaggctgatctaaaacccctgtgtcaaggcaatcaacccgcttaagcctcaaacaggactggaagggttcccgacctcaaat

SEQ ID NO: 88524 - DNA, 897 bp, Homo sapiens
tggctctttcaactgatgcattaaacagataaagatatttcttggagagttcagtcagttggctatgccgccagttataacagaaaccaattttcaagccgtgagttcttgttttttgttttttaccaaaggtactgtttccgtacactggtattaaaaaaatggattattctttttgatataactaagatgaaacattttttcattttttcctgtgattttcagtttgtcatttattattatatttaccagttttcgtttctatgtgccttacacacaactctcacaaactttgtttctccatttgctttactctttttttaatcaatctgtctagtttgtcctgatgaaaccaagtaccatagacagggtggcttataaacaacataaagttatttctcacagttctggaatcagggaagtgcaagatcagggtaccagcatggttggattctggtgagggtcctcttccaggttgcagactgccatctgctcattgtatctcacatggcagaaagaggactggagggctctctggggtatctttcataagagcactaatcccactgacgagagctccactttcatgatctaattaccccccaaaggccccacctcctcatatcatcacattggaggttaggatttcaacatatacatttctgggcaatgtatacaattccattggacagtcttacaatcttttcagtgtttacatgcataatttactgcaagacttggaatgaaacttcttagctttgcttggtctatataatatgcttcatcttaagcaagctctacattactagtgatgttaaatttcagtaaatggaaaaattccttgagaatactatattctctttcattatccaaatacctctaattttacaatttgat

SEQ ID NO: 88525 - DNA, 276 bp, Homo sapiens
gatttattgcttcaaggcatttcaggaaatctctgtccaatcattagctggccagtaagctaaccaaccagagacttcagtggctgaatgctacaaagaatacagactttacagaattggcacagggtggccactaaacaaacatatcacagaaacaacagcaacaacaaacactgggaattggtggaggtagaatctgatgctcagatttttcacattacataatttaaaatgttgtttttaactaaaatgtacaaggcatgcaaacaaaaagga

SEQ ID NO: 88526 - DNA, 157 bp, Homo sapiens
acaccagaggggagaatccagagaggactcagaggtgaaactatgccttttgacagtgacattccttccttcaaaacacttttcctaagaaaattaagaaggcaaggacaagggacccagaatcctccctaaagccagacaataattaaatgagagc

SEQ ID NO: 88527 - DNA, 497 bp, Homo sapiens
ttcctcccatgacatgtgggaattgtgggcgtaacaattgaagatgagatttgggtggggacacagccaaaccatatcaatacctcaacataataaaggccacatatgacaaactcacagctaacattgtattgagtggggaaaagctgaaagccttttctctaagagctggaacaagacaagaatgcccactttcaccattcctattcaacatagtactggaagtcctagccagagtaatcaggcaagagaaagaaataaaaggcatctgaataagaaaagagaatgtcaaacggtccctcttttcagatgatgtgatcttatagctagaaaaatttgaagactccacgagaaaactcttagatctgataaaacaaattcagtaaagttagtcacaggttacaaaatcagcatacagaaaataagtgctgtttctatacaaaaataatgaactagctgagaaagaacacaagaagacaaccaaatttacaatagtt

SEQ ID NO: 88528 - DNA, 337 bp, Homo sapiens
ctttaagcgagaagtagatgtggggaggggttgttgcatttttaaagattcctgtattaggccgggtgcggtggctcacgcctgtaatcccaacactttgggaggccaaggcaggcagatcacctgaggtcgggagttcaagaccagcctgaccaacatggagaaaccccatctctactaaaaatacaaaattagccgggcgtggtggcgcatgcctgtaatcccagtcactagagaggctgaggcaggagaattgcttgaacctgggagccagagattgtggtgagccaagatcgcagcattgcactccagcctgggcaacaagagtgaaactcca

SEQ ID NO: 88529 - DNA, 210 bp, Homo sapiens
ggaaagccggtgcgccctggcttcccgcctctagggcaggtccagcagggagtgctcggcgtagagcttctgggagacgttgtagacacgctggatgaaggggagggcctcgcctagcatctgcacggcctgctccgggggccccacgttcatggcctccaggaagacctcgcgtgtgggcagcgtgcagaaggccacggtgacggcacg

SEQ ID NO: 88530 - DNA, 611 bp, Homo sapiens
tctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggcca

SEQ ID NO: 88531 - DNA, 428 bp, Homo sapiens
tttaaattctatctttcctcttttgcatgttgagcagaaataacttttacttggctgctgtccaaaaatagtgatgggggttaaattggtgaaaatcagagctataatttccactggcctccagtcaagccatccaccattgagctctggacaggccttctgtaatttttttatacaagcaacatttgtcacattagaatatccagagttccagtctgggcaacatcatgaaaccccatctctacaaaaaatacaaaaaaaaaaaaaaaataggtgggtgtggtggcatgtgcctgtagtcccagctactcaggaggctgaggtgggaggatcacttgagcctgggaagcagaggctgcagtgagctatcacaccattgcattctagcttaggtgacagagtgagaccctgtctcaaaaaaaaaaaaa

SEQ ID NO: 88532 - DNA, 241 bp, Homo sapiens
aaagcatggcctggtttagcagaaatgactgctgccctggtggtactggacaggttgcctgaagagcattgtatcctccccttaccgtgctgtcaaataagttagaccgctacccatacttaattcattctagaagtccacaactgcatttatatcatcagttttattaaatacaagataaacttattttagagtttttgtttcaaagtcttttctcaaaatttactaggaaagtttgggc

SEQ ID NO: 88533 - DNA, 415 bp, Homo sapiens
tccccagggcacatgtcctctcccgcggctcagcccagatccatgcctggtgggcgggtggtggaaagctcggtgctggttttttcctgcccccttctggagcactgtctccagctggcatggaactgggtgcctgtcgtttcttctcagtaccggaacctgctctcagcaccgggacctgcccagccctgtcttctggcttctgccccagctcacgaggctggtatctgtccgagtgccaggactcagggcgcagtgtccagcagccctttcctcgtgcctgtgcatcggccacactgtgtccagggtttccagggagcaggggatccggtccctacccaccttgtccccagaatcggaagcacggtgctctcacagtgctcttaacaaagcaccttttgtcactgtgttgccc

SEQ ID NO: 88534 - DNA, 402 bp, Homo sapiens
aaacattaaaaaaagagaacaactaatactctttttacactaattagaacaatgtaagcctttttgttttattaccaaataatttgtatttcctatgtaattgctgcagttttattttgcatatagattttttttccgtaacatctttgtctgttagtggttttatttatgtatttttttaatatccttagattcatcccacttctgaggtcagacatcacatcttttcactacatgcctctctttgggaggtttctttcttgctaatccaaacaagaacatctgcacaattgtcaacctggaatttactttattaatctcctggtttggaaacactttttcttggatgttatatttactttggtttactattttgttggcttgcactaattttatatgatt

SEQ ID NO: 88535 - DNA, 514 bp, Homo sapiens
gtaaacaaatcattctggtaaagtgtttttttttttttaaagactcaaaaagttaccagtttcttaagacccaaagcagaatcccttatatgaagctttataaagatttcgtaatggagaaagcctacatttagcttttgatgtcttttataacaggctgttatctagcataatttatattgttaatatatcttacaaaatgcagataattactaatactggtataggaattcttaaattttggagaagggggtttaattttaaaagagcataatattggaatcagcaatgtaaaattatcaaagacaactagaatctgtattttttaaattggcaaagatatcagagtaaatagtattttcctgtgagtttcaagttaaagttttacttaatttcaaagtttgtggactttagagcaagtaaagatgatgagtaaatcacatagtttgggttttattcaagttctaaaactcaagttaaagaaaatccttgaggccgggcacggtggctcatg

SEQ ID NO: 88536 - DNA, 1129 bp, Homo sapiens
tgcctggtgattttaattatttaaatatttctctgagtcagttctgaaaaatgtagtgtgacaaatgcaataaactttaagtgttcggttttatttaactttttcaaagtaaatatatggagttgtgggtaacttttcaaaattattttttgctaacacatatgtctcacattctacaaacagtgctgtgtaattgtaagtgaagtagactatgatgaaagtgcacgtttatgtaggtttacaaggtaaattgccatataatgtagatcatttagattaggttagtattatttagatacagtttaagaaaagtagcttactttcttaaatttatttttaagtatttactcatttatttatttattgagacagggagtctctctgtctcccaggctggagtgctgtgtcatgatcatggctcactgcaacctctaaatgctgggttcaggtgatcttcccgccttggctttctaaagtgctgggattacaggcgtgagcgactgtgcctggccaaggaaggtaactttcaaaatacttggtgatctatttactcttcacctaggtattgaatgaagagtcaataaacttaaagatatatttgttttctagtcttctttaatggttttggctatgatatcctttttaaaattgtcaaatgacaatgaacttacataaatttttagtttaacatttcaccagcacttaagggactttatcacacaatatctttcctacatttttatgctataatggttactatttcaggattaatggaagtgttcactcctgagttcatttcacaaatttaaatactaaaacattttgttctttgaaaagtaattctggccaggcgcagtgtctcacgcctataatcccagcacttggggaggctgaggtgggcagatcacttgaggtcaggagttcaagaccagcctggccaatgtgatgaaacctcgtctctactaaaaatacaaaaattagctgggcatggtggtgcacacctgtaatctcagctacttgaagggtgtgtcaggagaatcacttgaacctgggaagtggaggttgcagtgagtcgatatcatgccattgcactctagcctgggcgacagactgagtgagactctgtctc

SEQ ID NO: 88537 - DNA, 398 bp, Homo sapiens
ccccgtgcactgaagaattaagaaaatatccacattgaagtgagtaggaaaagcagagaaagactcatgcacaaactccaccctgagcacaccactttaggattcccatctcctaggtttttcctgaggagtgaagggttcctacaacacatatggtaccccagcttttatgatccctgccagcaggtttggctcttaaatcaccttgcatggagagcagcagggatttggcattggataatttctttgaagcacaaagatcacagaagtggttttgaatcatgcaaacactctcagcagctgtagctcctgggttcagtccagcttctggcttctttctggaaggagtttgcacacttcccaagcaccaccctgaggtctggtttctgactagcctg

SEQ ID NO: 88538 - DNA, 604 bp, Homo sapiens
cctcccatcctctgtctggggacagcttgtctccttgccatctctctgttttacccatattccccctcctctggagttcagactcctgctgtcctcctcccggggacccatcacagtagtatctcaggttgtcctgagctgctgcttttggggcaaggctgggaagttgggaaagggagtgatggggatgtgggcagcacctctggtttcttgactgtccctgcaactcttctgggctggatcaactttgtgggacccactaagacacttgggagcatgttggcattagcagcagatatggatgttgtcagtggaaacagatagaagcctgtcactggggagagatgtttagctggctttggatgctgtgagttctcccccgaccccctgcaccctggcacttgggattcacgcattgaatgagaaaggagtggaccagattccctgtccctctcctctctctttttccaccctgccaccccatttccctcaaacttccctgggccagggaaggggcctgatgatctctgagcctgctggaggatacctggatagcgcatggcaaagtcctgcagtgaggcacctggggcttatgttggggggc

SEQ ID NO: 88539 - DNA, 504 bp, Homo sapiens
cctcccatcctctgtctggggacagcttgtctccttgccatctctctgttttacccatattccccctcctctggagttcagactcctgctgtcctcctcccggggacccatcacagtagtatctcaggttgtcctgagctgctgcttttggggcaaggctgggaagttgggaaagggagtgatggggatgtgggcagcacctctggtttcttgactgtccctgcaactcttctgggctggatcaactttgtgggacccactaagacacttgggagcatgttggcattagcagcagatatggatgttgtcagtggaaagcaaacctccagttccaaagcactcctgactccctctcctctctctttttccaccctgccaccccatttccctcaaacttccctgggccagggaaggggcctgatgatctctgagcctgctggaggatacctggatagcgcatggcaaagtcctgcagtgaggcacctggggcttatgttggggggc

SEQ ID NO: 88540 - DNA, 287 bp, Homo sapiens
ctaacccctctggtccggggctgaaggctcagtgccatggtctcagggcagcagatgaagcctccctcccctcagcccccagtttcctgtcgaggtagtcctttatctggtgagtgtcccacggttctagttgggcgaagtgcgtgcaggcaaacctttatcaggcgactatagcgtggatcagattgctaaaaggtgtacacccggccacctgttgtgtatcaggtgaataccccacaggtctggctggggggaggtgtatgcaaagccacccggtgtttttgatg

SEQ ID NO: 88541 - DNA, 222 bp, Homo sapiens
aattggccttgtgacattccttctcctgggcaacgagtctcatgatctccccaccctgcaccttgtgagccccgtccctgcccacaagagataaccacctttaactgtaattttccactacctacccaaatcatataaaactgtcccacccctatctccctttgctgacttctttttcagactcagtctgcctgcacccaggtgattaaaaagttttattgc

SEQ ID NO: 88542 - DNA, 576 bp, Homo sapiens
agttaatgcatggtgtgtatctctctgttgtttatttaccataagttactaattcccatttctcagctgagagctattataggccttcctcctcatcagggatagttggagccagataggatagagattgggtaactgttggaatgtggaccaccaatttcttttattggcttccatagctagttagatggagactcctgacctgagtgaggagtattatctgtcctgtgagcctccagttagcctgggtaaaaacaatacattaagaatcactacctcttcttagccaagcatggtggctcaggcctgtaatcccagcactttgggaggctgaggcgggtggatcacaaggttaggagtttgagaccaacctggccaatatggtgaaaccccatctctactaaaaatataaaaattagctgggcatggtggcgggcgcctgtagtcccagctactcgagaggctgaggcaggagaatcgcttgaacccaggaggcagaggttgcagtgagcccagatcgcaccactgcactccagcgtgggtgacagagcgagactccgtctcaaaaaaaaaaaa

SEQ ID NO: 88543 - DNA, 177 bp, Homo sapiens
gatctgaaactcttttatgcaaagaatagattactaaaaagttctacataaaagagaaataaaacctttagggtatattatgaattatgtcttaaagttatcctcaacaagaaagaccatatttccatagttctctaacatcacattcgtatacaacttccgctgtacagtgtccag

SEQ ID NO: 88544 - DNA, 366 bp, Homo sapiens
accattctactttctgtctctatgaatttagctattctttctataagcttttaatcaggcagcaagacagaccgttaatatatggaactgggaagtctgtgccccactctgatgtgctgtgagatgtttcgttcagtcccatggatggagggattgatacctctgtaccctactgctgccaccccccactgcccgggctaagtgtgtgagcaggacatagacacttcaaatggtaatgaaagctggtgtctcctgctgatctggagggcttccctaaagatgaaggaccaaagtccctggagagttgtcatcgccttgaaaacacaagggcttagaccactgctgtgacccttcaccagcctgttt

SEQ ID NO: 88545 - DNA, 286 bp, Homo sapiens
caaaacagtgctctaatgggcagccctaagtacacacaggggtaagactgcctagaggatgacaagtgccatgacggaaagcagttcgttcctttttggtctagagccaggatcctagcctcaagtcaaggctttcaagaactcatttgtagaagtgaaactcagagaccatatagagaacttcatttctcctggggggcccatgaaatttatcttgcactaagtttcttctgtttaaaacgcgagtttgcatggccgggtgcaagtggctcacgcctgtaatacc

SEQ ID NO: 88546 - DNA, 659 bp, Homo sapiens
gcacagcacgaggcagaggaacggagacaggtcctcggaagcctctttccagaaaatctaatttcatcattgagaaatcttctgtcttaaacagcctccaccaccgccataaatttacatattctatatgccgccggaacggagtgggccctatttgcataatgctgctggaggggctcacgctcctcttgaacctgaatgtagcaggagcgaggaagcaattattaagctgtagacgttggcagggagagagccctcagatggatttcgactccaaacctcattcgccagggctgctcattaccgaaggcctggatcccaggctgaaggtggatcccagggctgggaaaaatcagtgtgaattgctttctccaggttatgtctgcagccaggccgaggccagatatggggggtctttgagcatcctggatgattcattgccttgctcagcaatttattcaacaatcacaggacactggacacagagatgaacaaaacaaatggacttcctgccctcacaaggattacggctctagagcaggaagacaaaccttcatcaaacaacatgtaaatacagtcatgcgtcatttaacaacagggatacgttttgagaaatgtgtcattaggcgatttcatcatcgtgcgaacatcatggggta

SEQ ID NO: 88547 - DNA, 821 bp, Homo sapiens
tggttctgtgttcttgacgtaattaggaggccacgcagctctccaacactccgttaaacaaatatctctttcttaggaagcggagagaggggcagaaaacgtgcacctcgccacccaccggacaagccgagaggaccttgtctttgcttgaaaagttttctagataaatcgctcgggtggttctaagctatgacgaactagaggctgggcccggttcttctccagaacagcgtgtggatgtaaaggagatgaaatcgtcctcccccactgctttctttttcttccccatataaatcagtcatataattcattcgcattgtttaaggtacattgatcaatctaatggcttgtaatagtctcctaattgccacttgcagactcctgcaggctcagatttgaagagggaaggttccagccaagtccaccttaagcctgagtttgggcgactacagaatccaggaagaaaatctagatggcatggtcgctccggtctcagttctacaggggagggaagaaagggggtgttagtggggatatttgctgttcatttttcccgcaatctcccttccaaatcagtcactgattaatgagcaaagcccatgccacaagttatagattactgtggactgaggatcattttgttaatatcaggcaagaaacttgccttacttgcatccctgtgtctgtatttacagtaacaacttccttagtcacaaactgatatgcttttagccataccttttcttcttacttacttatttttagcatcatcaggagttgggataggacataacatgggggaggggtgtgttaaagggaag

SEQ ID NO: 88548 - DNA, 313 bp, Homo sapiens
ttaggacggagtggtgagaacagcccccttccttttcctcagcttgacggtcccagcctttcccattgcggacctagagcccagactcccagggcagaaagcgccccacagactgataaaggtgaacaatccaggctttgtttccaagggctttatccctgactttccaactggcttttatctgtgtcttcacgtctctgacctcttgagcctcacaggagctagactagaaggttcaagttcttgaggagaaggcaggggcgggagagccccacttgcgggaatctcgtgcggaccgagtcggggcgggaga

SEQ ID NO: 88549 - DNA, 465 bp, Homo sapiens
gaattcaatcaaattcctatagtaaggtacaacttcagggaatagaataaatcatttttaatatgagctaagagatgtcaaatcctgcagaacagatttatcagtggtatgtattagacctcccaacactttgagacacattgattttctttctgtgagattcagaaaaaccatggaaagtctgcctacttgggtatgagggttataattcatattaatgcctctggtttgagattatttcttgtccctgttagctggtaaagtagattgccaatttgttctaatctgctcatggaactacattcacaattttaaaatgtgttttcgtgaatctttaaacaaaactgttttcaatctaacctttatgtcctaagagttccacaaacattcaaatggctgttttagtaggttacaaagcatagtaaaatgtcatatttaacttaggatagatgagaaccaatgtgt

SEQ ID NO: 88550 - DNA, 369 bp, Homo sapiens
agggaagggtcacactggcatctacagtaaagggagggacctcactggcatctacagtgatgagagggacctcgctgacatctacagtaaagggaggggccacactggcagctacagtaaagggaggggccacactggcatctacagtgaagggaagaaccaccctggcatcaacagtgatggcggatgggcgaccagtgtagcggtgtctggagctgtggttggacccattagttggggctgctaatcagttcaccatgcaggctgtgggccaagccactgaagggatgcacctggactaggagtgactgggctgggtaagcagtggagctggccagagtacccaggcagggaggaggagccctgggg

SEQ ID NO: 88551 - DNA, 400 bp, Homo sapiens
catctagaggatcccatccccggttctgggttcaagggattctcctgcctcagcctcccaagtagctggcattacaggcgcccaccaccacacctggctaatttttgtatttttagttgagatggggtttcaccatgttggccaggctggtctcgaactcctgacctcaagtgatccacctgccttggcctcccaaagtgctggggttacaggcgtgaaccaccgtgcccggccttactaacatttattgagtgcttcctatatgcaaagtggtgatgcagtgatgcttaacaccctgtctctagagacccatatgcccaacaactaaagcagtagtttaaatttcctcttaactcttgcaattagagatagattatgtaaacctgaattatttttaata

SEQ ID NO: 88552 - DNA, 460 bp, Homo sapiens
cagcttataatactacccagtggcatagaaaattactatgaagtttttccttaagtcccaaccaaaagctcatagttaaaaatataattaaggacacttaacattctatttaaaaaattacagtttaagcagaatacatatcatgtaatgtatctgaacccatttagcaatcagagaataaaaagaaaacacaacaaaaaatattatataaaaagaaccaaaaaatatatattactttctttttccccattaggttaaagggtactttaagatcagttaaaaatatgtttctgaatgttaagaaatgtatgtgatagaaaacaggaccaaagaaaattaatgctaaattaactttatacatgaattgattttttttcttttttaaagaaatgaggtcttactttgtcacgcaggctggagagcggtggtgcaatgacagcccactgtaaccttgaactcc

SEQ ID NO: 88553 - DNA, 856 bp, Homo sapiens
cagagggttgctggcaaagcacaggaccacaatacccagggatccttgctgctagtgtcccggatgctgagggcctgcgacggcttctgggaattgcagtccggtcgcatttctccttcttaccagcgcgttttcagtttcatagggaagcctttccatgaaactggagcgcctggaggagaaggggcccagagctagggaggccctagcgatttctgcgaaagagttccaagtataatttcactgccaacagtgtcataactactttgcctttatacttagtacagctaggttcggttctaatgccagctcagagcagtgctccaagcagggcttaagaatctgtgttgtcggttcttagttctgggccctgtgctgcaggcacctgcaatccgccagcaaccccttcatccctgcggcgggtctaacctaagaggcattgagaaagctttgctaaggaggaggtacaccgcacgctacagttcccgcgcctttgccgaggcgcttcatttacctttgccaaactcgacacctggaactccacgacttgtgtgctttctcagcctgacacctggcctgaccaacttgtttccagtacattaagggccaaggacgaatttaatctccgcctagaatagtctctgaggtacactgacaagttgccagtgttgagaagcatcacagggtccagaggaaaggcctgggtttgagtagggcgtgcccgtatttatccactctagttttcttgtctggacgtcagcctttttacttgggacattatctttcccctctctgcttcccaccagtcaagcaaagttcttcactttataaaataagccagatgccccagacctag

SEQ ID NO: 88554 - DNA, 490 bp, Homo sapiens
cctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaagga

SEQ ID NO: 88555 - DNA, 845 bp, Homo sapiens
aaaaacaaagaaaaattcctcagagctcatacaaggctgggtagaatatgtgtttcaacaatagtggatcttttaatatagtacatggatcattgagtagagtcttcagcaaaatattggcaaagtagggttagggttaggttagggagatgggaatagactgaagactactctggacttgccctaacagagtttaagagcaacatttgaaaggatcaaactgatttcaagtaacttgagtgcatccaagggagaaaacccatcaaaataaaaataaaaactacaataaaatccagcaccaaaagtgtaacattcacaatgattagcatctaataaaaagttaccaggcatgaaaaaaaaaaggaaaaggcaatccacagtcaagagaatctttagtcaatggtaatagactgagaatgacagatgatggcattagtaaatgatatggtttggctctgtgtcccaacgcaaatctcatgttgaattgtaacccccagtgttgggggagggacctgataggaggtgactggattatggtgaacacctatatggatatgaatatggagtattctccatggatatggagaacaccccttggtgttctcataatagtgaatgagttctcatgagatctggttgtttaaaagcgtgtagcacttccttcttttccctctgtgtctcctgctccaccatggtaagatgtgcttgcttccctttgccttctgccattgtaagtttcctgaggcctcctagccatgcttcctgttaagcctgtggaactgcatcatttaaacctcctttcttcctaaattacacagtctcaggtagttctttatagcagtgtg

SEQ ID NO: 88556 - DNA, 224 bp, Homo sapiens
aaattggaaacaatcagaatccaacactgtcagtgtggttaagataatgatgctacactgataccatgaaactttattgcagccattaacagcaatgtttacaaagagttcatggaatgagacatcagataaatgtcgaaaaatcaggataaagttctatatatagtgtaggattttcatatcactatatacaatatgcatagaagactaaaagaagatatgcc

SEQ ID NO: 88557 - DNA, 413 bp, Homo sapiens
acaaaatcccatgcatgctatcttatttttggtgacaattacatggtcctggtttccgctcccctgccatcagtggtctccttcctcagtcataaatggcttcctgctctgcttgccatctacacgctggagggtcttgcctcagaacttagtcactagtcttctccatcaatgtccactccctaggtaacaacccttccctcctcacctagtcacataatttaaatgccacctacatgccaatggctcccaaattccaatcctctgccacaggactgtccacaaaagcgcagtcttttgcttagaaactgactgctccccttggatgtctatcaggcaactcaaagcattttaaacaaatattaatttcccctttccccatttctataaacagtaccagttgctgaagccaa

SEQ ID NO: 88558 - DNA, 276 bp, Homo sapiens
atataaccaactttatgtttcataatctctaaaaggaattccttaggaaatatttctgttatgaaaatacaagattcatctggtcattcactttcctttctatttaacttttctttaaattgtactaaagttaattgttttataaagaatttctatactatgattctgttattaggatgcatttcttctatcagtatatatacttaatgggtgtctgcaatcttatttatttagaagactgagtattgaggcaagggaagtacttttctatgttac

SEQ ID NO: 88559 - DNA, 505 bp, Homo sapiens
gaattgtgttggcccaatataatcacaaggattcttaaaagtagaagagagaagcagaagaggaggtcagcgtaataggatgtgagaagaaccactgttgctggcttaacttggaggaggaaggccatgaagcaaggaatatgaggtggctactagaagttggaaagggcaaggaatcagattctttttagaaaaaggaatgcaggctgggggtggtggcttacgactgtaatcccagcactttgggaggccgaggtgggcggatcagaaggtcaggagattgagaccatactggccaagatgatgaaaccccgtatctactaaaaatacagcaattagctgggcatgataaagttccatggtggcgcgtgcctgtaatcccagctactcaagaggctgaggcaggagaatcgcttgaaccagggagtcggaggttgcagtgagccaagatggtgccactgcactccagcctggcaacagagtgagactccgtctcaaaaaaaaa

SEQ ID NO: 88560 - DNA, 290 bp, Homo sapiens
gctctcaaggttttgttctagaaggtgattttacaaaatagcttaagcagtccttcaaatatgaatttaaaggtcattttgatatttctaatatgaactgaaaattcattgtagttgaagttaaactagtctctagtaaggtttattttaaataaatacgttgtactattttagtgaagaaagtccaagttatgctgaagaaaaatcctagatttttaaaaaatgcatttggtatctcatcacagtagtgacaatcagtattacaattatgacttgttcatatataccta

SEQ ID NO: 88561 - DNA, 305 bp, Homo sapiens
ccctgctcaaagcttcctgattcctgttaagttcaatgttttctgacagacacaagccaattagctgtctgctgctggcggctggtttattcaacatggtttgctgttttgatttgaaaacctaatatttttcagggatttgatttggttccactggggagcagagataagctgttcagcctcagccgctgagctggctctaatggccctcattcactgcatacccagtatccagtgagttctcaggctgtctccagcttggatgtaagaagaggcctcctccgggcatctgtagtcccagctac

SEQ ID NO: 88562 - DNA, 580 bp, Homo sapiens
tcctatggtgtgccttttgaactgtaagtggagcaggaaaaagtttcatttaaaatgtattttgctaaatttaacaagaaatcaaaggtgtttcctgcttatatttttttcttactgcagaggttttagtatataccaaactcctgtgcatcaaaatggcaaaaatctaatctgaggcttataataatcttttgataccctaataaaggtaagcaaaaccatttaagaaaattgatgttaaaataacccaaataagcctgtgtcttaagatagacaaaagaaacaatatattgcttttgtatttaaagtagtttatttttactagagtttactaatttgtcgtattgtacatcctttgtatatgtggaaggtattcattattctaatgtaaccataaagcagaaaatctgtaaaagagtaatatggaaagctctttcctcattatgtttgtaaataggggaccctaaagtaagaataacaatgaaaataagactcctaatctgaacgtaaattaagaaatgatactggcttccttcctaaccttaatttcttaaatttgaaggcttatacttttctccct

SEQ ID NO: 88563 - DNA, 452 bp, Homo sapiens
ttctcagcattgggagtggaggaggatatattttgtaacaatattcaagggaattctgatagggacccattcatcccttaggccttttcactgataaagatttcaaaaaataaaagatgtgaaagagactgattcagctagaagagataggggagggctcttcatgtgaagggattgtgaaagagaggagactggggtccctggagcagagggtgcatcagaggaagtggtaggaaatagggtggggtattaagatggggaagtcaagaagaaattggaatgctaggtcagagagtttaatccagatgttgtttgaaataagaaattattcatgcattcatttgttcaataaatatttatgagcacctactctgtgccaggcactgtgtcatgtgctggggagaaagtggagaatgaaataaagctctttccctcataaaacttatattctg

SEQ ID NO: 88564 - DNA, 190 bp, Homo sapiens
catgtctggatggatggatggatggatggatggaaggagggttggacggatggatggacagatgaacagatggacttgagcatttattcggggtcctccacagaattgagtgatttccaaaggtgtctcatcacctgcaggtgggtgggcaaaagggcttgcctctgtaatactcatgattacgggtagt

SEQ ID NO: 88565 - DNA, 211 bp, Homo sapiens
cctgattcctctggctaggacttccagtactgtgttgaatagaagtggtgaaagtggtcatccttgacctatttcagttctcagggagaatacttgcagctttgtgccattcatgatgcaactgtcatgatgttggatgtgggtttgccacagatggcttttattttgaggtaagtcccatctatgcctagtttgttgagggtttttataa

SEQ ID NO: 88566 - DNA, 468 bp, Homo sapiens
ttagtagagatgaggtttcaccatgtttgccaggctggtcttgaactcctgacctcagatgatccgcccacctcagccccccaaagtgctgggattacaggcatgagtgcccagctaaatgtttattcttaaccaggattgttaataacttaatttactgtcatagagttaaaagtttggaacagtagagagccttatatatacttcatggtgttctttctactgtcagaaggccccagactggaatttttggtgtgtgtgtgtgtgtacgtgtgcgtgcatgttttaaagatataaaacaaggttatggctgattgtcgcttcatcagacagttttaaaattttgtttacttttgttccttattatcaaagtaatatatgttcattggagaaagttcatcctcccctcccacattggagaggcaaccgctcttaacattttggaatatttcttttttccttttttct

SEQ ID NO: 88567 - DNA, 1688 bp, Homo sapiens
gtgtgtgtgtagacagggtcccactgtgttgctcaggctggtgccaaactcctggcctcaagggatcctcctgcctcagcctctcaaagtgctgggattacaggcataaaccacaactcaataaaaaagtttttaaaaatttacaaagctcatatttgatccagctaggattttaccctgtacatttgtatttcttgtaggctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacagctgttgtgatacctcagttcttgtcttcttggtttaaaagaatttaaatgagacagcaaaggagatgcagcataatttattgcaaaagaaaaggagtattttgaaagttaggtgcagaacagacagtacacctgagagagagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagctgttaatgcttgttcatacaccacatgtctcagtagcatcttaaatttccacctagaggtgtgttttttattattatcatgtgcaaaggatcagtttgaggacaggtaaaatcaaaatgtgtatgctctctagaagggaaagtccctactgaagatagctttgcttaaatgagctcaattacaatgtgaatgctgaggtttattgtgttggctgtatggtcatgagaaaatggtcatttccttgactacctgatacggtttggctgtgtccccacccaagtcttattttgaattgtaatccccataattcccacatgttgaaggagggacttggtggtaggtgactggatcatgggggtggtatcccccatgctgttctcatgattgtgagttctcacgagatccaatggttttatacatggtagtctctcctgctgccatgtaaaacatgcctgcttccccttctgccaggattgtaagtttcccgaggcctgcccagccatgtggagctatgagtcaattaaacctctttcctttataaattactgagtcttgggtagtattctttatagcagtttgagaacggaataatacactcctatcctgcctcacgtgttagacacattttgagtgtcctcagatccctttggcgctattatctcctggactcttagctgcttggctgcttctcccttggcagctccctgtgcagaggaccacccaggacatgattactgcaacacctcacct

SEQ ID NO: 88568 - DNA, 1634 bp, Homo sapiens
gtgtgtgtgtagacagggtcccactgtgttgctcaggctggtgccaaactcctggcctcaagggatcctcctgcctcagcctctcaaagtgctgggattacaggcataaaccacaactcaataaaaaagtttttaaaaatttacaaagctcatatttgatccagctaggattttaccctgtacatttgtatttcttgtaggctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacagctgttgtgatacctcagttcttgtcttcttggtttaaaagaatttaaatgagacagcaaaggagatgcagcataatttattgcaaaagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagctgttaatgcttgttcatacaccacatgtctcagtagcatcttaaatttccacctagaggtgtgttttttattattatcatgtgcaaaggatcagtttgaggacaggtaaaatcaaaatgtgtatgctctctagaagggaaagtccctactgaagatagctttgcttaaatgagctcaattacaatgtgaatgctgaggtttattgtgttggctgtatggtcatgagaaaatggtcatttccttgactacctgatacggtttggctgtgtccccacccaagtcttattttgaattgtaatccccataattcccacatgttgaaggagggacttggtggtaggtgactggatcatgggggtggtatcccccatgctgttctcatgattgtgagttctcacgagatccaatggttttatacatggtagtctctcctgctgccatgtaaaacatgcctgcttccccttctgccaggattgtaagtttcccgaggcctgcccagccatgtggagctatgagtcaattaaacctctttcctttataaattactgagtcttgggtagtattctttatagcagtttgagaacggaataatacactcctatcctgcctcacgtgttagacacattttgagtgtcctcagatccctttggcgctattatctcctggactcttagctgcttggctgcttctcccttggcagctccctgtgcagaggaccacccaggacatgattactgcaacacctcacct

SEQ ID NO: 88569 - DNA, 2252 bp, Homo sapiens
ccctgagaagaaggtaatgctattctcattttagagatgaggaaatcaagctgagaaaagtcacccgaggtcatacagttagtaagtggctgaatgaggattcaagtccaggtctttgcggttcggaagcagagtttgcatggctcagaggccccctgtggcctgcagacatgttttgttaggttggcttagtgtagtcaaacaataagactagtggctgacatttagaattggaagatgtcatgacagatctgcatttctggctgctcttgaagactgtgatgatccagtgacatggactgtgttcttgtgtggcctgtgtgtcagctggcacagaggggtggctgtgccgcatggcagggcggcactcttgctgcctctcacctgcattgctcctggctctgaaggctgtgctctgctcactacattccactgtgtgctcctggattcacttgtcctagagatcaagttacctcttttgctggaagtatatcagtgaggatattttaatgtctcagctggattctcatgttcaattttaggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacagctgttgtgatacctcagttcttgtcttcttggtttaaaagaatttaaatgagacagcaaaggagatgcagcataatttattgcaaaagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagctgttaatgcttgttcatacaccacatgtctcagtagcatcttaaatttccacctagaggtgtgttttttattattatcatgtgcaaaggatcagtttgaggacaggtaaaatcaaaatgtgtatgctctctagaagggaaagtccctactgaagatagctttgcttaaatgagctcaattacaatgtgaatgctgaggtttattgtgttggctgtatggtcatgagaaaatggtcatttccttgactacctgatacggtttggctgtgtccccacccaagtcttattttgaattgtaatccccataattcccacatgttgaaggagggacttggtggtaggtgactggatcatgggggtggtatcccccatgctgttctcatgattgtgagttctcacgagatccaatggttttatacatggtagtctctcctgctgccatgtaaaacatgcctgcttccccttctgccaggattgtaagtttcccgaggcctgcccagccatgtggagctatgagtcaattaaacctctttcctttataaattactgagtcttgggtagtattctttatagcagtttgagaacggaataatacactcctatcctgcctcacgtgttagacacattttgagtgtcctcagatccctttggcgctattatctcctggactcttagctgcttggctgcttctcccttggcagctccctgtgcagaggaccacccaggacatgattactgcaacacctcacct

SEQ ID NO: 88570 - DNA, 2021 bp, Homo sapiens
  misc_feature (3)..(3): n is a, c, g, or t
  misc_feature (9)..(9): n is a, c, g, or t
  misc_feature (20)..(20): n is a, c, g, or t
  misc_feature (30)..(30): n is a, c, g, or t
  misc_feature (32)..(32): n is a, c, g, or t
  misc_feature (43)..(43): n is a, c, g, or t
gangacagnattggccacangcttgccaangntgcagtctgancttgcggtcctcggagcctgcctttgtcatgggcccggagggaacccctgttcttgtgccagaatggcagcatccactcggaaactgcttcttcagctcaaacaagagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacagctgttgtgatacctcagttcttgtcttcttggtttaaaagaatttaaatgagacagcaaaggagatgcagcataatttattgcaaaagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagctgttaatgcttgttcatacaccacatgtctcagtagcatcttaaatttccacctagaggtgtgttttttattattatcatgtgcaaaggatcagtttgaggacaggtaaaatcaaaatgtgtatgctctctagaagggaaagtccctactgaagatagctttgcttaaatgagctcaattacaatgtgaatgctgaggtttattgtgttggctgtatggtcatgagaaaatggtcatttccttgactacctgatacggtttggctgtgtccccacccaagtcttattttgaattgtaatccccataattcccacatgttgaaggagggacttggtggtaggtgactggatcatgggggtggtatcccccatgctgttctcatgattgtgagttctcacgagatccaatggttttatacatggtagtctctcctgctgccatgtaaaacatgcctgcttccccttctgccaggattgtaagtttcccgaggcctgcccagccatgtggagctatgagtcaattaaacctctttcctttataaattactgagtcttgggtagtattctttatagcagtttgagaacggaataatacactcctatcctgcctcacgtgttagacacattttgagtgtcctcagatccctttggcgctattatctcctggactcttagctgcttggctgcttctcccttggcagctccctgtgcagaggaccacccaggacatgattactgcaacacctcacct

SEQ ID NO: 88571 - DNA, 2429 bp, Homo sapiens
cagagcaagactctgtctcttacacaaagaaaaggaaggaaaaaaagaagaaaagaaaggaaaaaagaagaaaaggacaaaaaaagctctaaattaggccctggggctgagagcggcactttatgctgtgtcttagctgagttgtataaacgcctccagctgagatctgcacacacagctggagcttctcagcaccagggactccagctgataaagatgtctcctgtgtgagataagttcaggacagaagctgctcatgatcataagtcctccccttctgtcctaccactctaccctgcagtgacagggaaaagatactgttttctgctctccagtagacagcaggacccctctctaaatgtttggtttgagatcttcttgtgaaaactcctaatacaaaaacctgatagagcttggatagctggtatgtttgatatggatacaatatatgagatctcaccatccagttttctcactaaccataaagtctctgaataatttgcttttacatattcccttttggaaaaatcctacaaattttccaagaggaaacaggaatccgacttcagttgcaaagttaagatgcttttccattaaaaatgacaccatctcatctagtattacatatatatgatcttacgtgatactcactattctatcagataggttttctgaatggagcccgatcttgtgggtagtgtattgcttgtacgaaatgaatatgtcatgttggggtaactagattggatgagggtggagttaggcttcataatgaatactttctcatatggcccttcctagttttgaatcaacggtaatttggaggctcctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagcctctcaaagtgctgggaattacaggcataaaccacatctgcaaaaaaaacaaaaaaaaaaataaaaaacaaccgtgtgttgggccgcccccgccgccccctgagaaaagccttcccaacaccctctcgccgtttggcaccgggggccacaaacagggtaagctgcacaccgggcccatcaccagctccccccaagacacacccccgggccagcgagaacaagggccgtggaacatccccaccactaaaaaacccgccgggggaacacacggagcggtttctagacaacacccaggagcggccactagcgagcaacacggggaattcataaaccggggacccaaggcgacctcgaactaaaaatcgccccgccaggagacagcgatcgccctgaagataccaacacaagcccgacccgccacacaacactactagacgtgataagccacacccgacgcgcacaccgtcaaccacacaccaggcaatgggcccaggcgcgggggggacacaaggagaggggccacagcggcgcacacgcgacgcggggggcggcgaccgacaccggcggggaaggaggggcggaacagggcgggcgggacacgaggagatcgcgactgtgcgcagctgcaccgagccccaggacatgagagacgacggcggcggacggcgcggtggggggcaaccgggccacgggggacggccgagtgtgtccagcacaacacgcgcgcggaggccgttgcagcaggccagggcggacca

SEQ ID NO: 88572 - DNA, 1332 bp, Homo sapiens
gtgtgtgtgtagacagggtcccactgtgttgctcaggctggtgccaaactcctggcctcaagggatcctcctgcctcagcctctcaaagtgctgggattacaggcataaaccacaactcaataaaaaagtttttaaaaatttacaaagctcatatttgatccagctaggattttacccttgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacagctgttgtgatacctcagttcttgtcttcttggtttaaaagaatttaaatgagacagcaaaggagatgcagcataatttattgcaaaagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagctgttaatgcttgttcatacaccacatgtctcagtagcatcttaaatttccacctagaggtgtgttttttattattatcatgtgcaaaggatcagtttgaggacaggtaaaatcaaaatgtgtatgctctctagaagggaaagtccctactgaagatagctttgcttaaatgagctcaattacaatgtgaatgctgaggtttattgtgttggctgtatggtcatgagaaaatggtcatttccttgactacctgatacggtttggctgtgtccccacccaagtcttattttgaattgtaatccccataattcccacatgttgaaggagggacttggtggtaggtgactggatcatgggggtggtatcccccatgctgttctcatgattgtgagttctcacgagatccaatggttttatacatggtagtctctcctgctgccatgtaaaacatgcctgcttccccttctgccaggattgtaagtttcccgaggcctgcccagccatgtggagctatgagtcaattaaacctctttcctttataaattactgagtcttgggtagtattctttatagcagtttgagaacggaataatacactcctatcctgcctcacgtgttagacacattttgagtgtcctcagatccctttggcgctattatctcctggactcttagctgcttggctgcttctcccttggcagctccctgtgcagaggaccacccaggacatgattactgcaacacctcacct

SEQ ID NO: 88573 - DNA, 2897 bp, Homo sapiens
cagagcaagactctgtctcttacacaaagaaaaggaaggaaaaaaagaagaaaagaaaggaaaaaagaagaaaaggacaaaaaaagctctaaattaggccctggggctgagagcggcactttatgctgtgtcttagctgagttgtataaacgcctccagctgagatctgcacacacagctggagcttctcagcaccagggactccagctgataaagatgtctcctgtgtgagataagttcaggacagaagctgctcatgatcataagtcctccccttctgtcctaccactctaccctgcagtgacagggaaaagatactgttttctgctctccagtagacagcaggacccctctctaaatgtttggtttgagatcttcttgtgaaaactcctaatacaaaaacctgatagagcttggatagctggtatgtttgatatggatacaatatatgagatctcaccatccagttttctcactaaccataaagtctctgaataatttgcttttacatattcccttttggaaaaatcctacaaattttccaagaggaaacaggaatccgacttcagttgcaaagttaagatgcttttccattaaaaatgacaccatctcatctagtattacatatatatgatcttacgtgatactcactattctatcagataggttttctgaatggagcccgatcttgtgggtagtgtattgcttgtacgaaatgaatatgtcatgttggggtaactagattggatgagggtggagttaggcttcataatgaatactttctcatatggcccttcctagttttgaatcaacggtaatttggaggctcctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacagctgttgtgatacctcagttcttgtcttcttggtttaaaagaatttaaatgagacagcaaaggagatgcagcataatttattgcaaaagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagctgttaatgcttgttcatacaccacatgtctcagtagcatcttaaatttccacctagaggtgtgttttttattattatcatgtgcaaaggatcagtttgaggacaggtaaaatcaaaatgtgtatgctctctagaagggaaagtccctactgaagatagctttgcttaaatgagctcaattacaatgtgaatgctgaggtttattgtgttggctgtatggtcatgagaaaatggtcatttccttgactacctgatacggtttggctgtgtccccacccaagtcttattttgaattgtaatccccataattcccacatgttgaaggagggacttggtggtaggtgactggatcatgggggtggtatcccccatgctgttctcatgattgtgagttctcacgagatccaatggttttatacatggtagtctctcctgctgccatgtaaaacatgcctgcttccccttctgccaggattgtaagtttcccgaggcctgcccagccatgtggagctatgagtcaattaaacctctttcctttataaattactgagtcttgggtagtattctttatagcagtttgagaacggaataatacactcctatcctgcctcacgtgttagacacattttgagtgtcctcagatccctttggcgctattatctcctggactcttagctgcttggctgcttctcccttggcagctccctgtgcagaggaccacccaggacatgattactgcaacacctcacct

SEQ ID NO: 88574 - DNA, 895 bp, Homo sapiens
tgccttgtagcattcaggtcaagcagcattgtacagggctatgaaagaaccaagaatgggctgcccttgggaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaagttattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaacta

SEQ ID NO: 88575 - DNA, 478 bp, Homo sapiens
tgccttgtagcattcaggtcaagcagcattgtacagggctatgaaagaaccaagaatgggctgcccttgggaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcaaaaaaaaaaaaaaaaaaaaaaaaaaaaaaaaaaaaacttaacaaacactataaccaaatcgacctttataatccaacaaattttatgattcgagccaatatttgagttcacttggcactattagccctataggcattctgacctcttgtgtccctttgtttttcacccgccttgcttggtctttggc

SEQ ID NO: 88576 - DNA, 1120 bp, Homo sapiens
tgccttgtagcattcaggtcaagcagcattgtacagggctatgaaagaaccaagaatgggctgcccttgggaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaagttattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaactagttattgttggtcagatttaatacaaatgtttttcctaatctgttttcttctcctgtgacattatctagcatgctttgcagtgggtccagagttgtctggggatcaagtttaagtagccctggaccaactggactaaatttgatcagcagtcaaattgttgctaagagctatgcacatggtgctgtatttggggtagcttttatgagaaaatagaaattaagatg

SEQ ID NO: 88577 - DNA, 436 bp, Homo sapiens
tgcttaccacagattggggaagaggaaatggggagatgcaggccaaggatacaaaatagcagataaaatgaacaagtctagagatagggctaaagttaatacaattgtattagggatttttgttaaataagtagattttagctgctattatcacaaaaaaactgagatgataatgttaatctgcttcactatagcagccattttattatctatatgtatcccataacatcatgttgtaaatcttaaatatacctaataaaataaaattgtcaccaaaatgcaagaattagagttaactttacctgtgaagccaagtaatgctcagagggctgcttagagatcacaaaatctgaacataggacgtagaggcatcaaatattcaaaatcaccaggcttagagagtctgaagtgagtcctgtgttaggaatattcttgc

SEQ ID NO: 88578 - DNA, 380 bp, Homo sapiens
atagttgtatcacaccgcaatctcaggaacagctctcttagatagtgatttaaagctgtggagcatgccctagcagctaacattcatcataaggaacattctgccatcagcagtgtgcaatctcttttttaccaccactaccgaaaaaggtggactggctcattcaggcagtattttaacagtgaacacacgtgttaaaatatcggtttcatgatattcaggcttgcatactgggtcatgaacatttactaaatgcacatataagtaaacctgagttgactatgtttgcaaattgatattattttcacagatgagtctcttcatttttcctttgtatttttgcagccattgaattaataaacgttagattgcggtgttag

SEQ ID NO: 88579 - DNA, 351 bp, Homo sapiens
gggcagtagcatctcacacctgagcacagggggaccctagtctgcactctgtgtcttagaaaacctcccatatcagaagcaccaaatgcaatggtaatggatagtgaatgagaactccagtagagctgaactgggtccctgtggccagaggctgcagagctggaagagctgatcctgtatgtcagggaaggagaaaagcacagtgtgtgccctggaaaccagaggaagtgtgatgtttcgccccccaagtgggcatcaaggtcgctcgtcatccttctgtcgtctgtcctgcatgaagttaggagcctccgattggtgcccttgcgcctggtcatgccctcttcctcccag

SEQ ID NO: 88580 - DNA, 184 bp, Homo sapiens
ctaccgtccagggtctctgttggagagctacatctacatttatggacctagacagtagccagccatgatgaactaaacttctgagaccatggagtaagggaatgactaccatgtggatgagacagaaggcatactgaaggtgaggctgtggctaaggtgaaaaagaagattatttggcagtgga

SEQ ID NO: 88581 - DNA, 318 bp, Homo sapiens
tgaacatatgcatatcccgtggcccagaaattctactccttggtatctactctagactataacaggagacaaccaggaagcaatctaaatgcccatctacagaaaatggataaataccatgtagtatattcaacttaatgagcatttaattgtgcagcaaggaaactgaataaacacaacatgaatgaatcttagaaatataatgttgaataaaaagccccaagtttgtcaagtctgcatacaatacgccatagtcccccccttatttgcagcttcattttccacggtttcagttatccacagtctattatggtccaa

SEQ ID NO: 88582 - DNA, 428 bp, Homo sapiens
tttttaaataaaatctaatttctagtcaccatccttcaaggaaattattctcccgatttacgagaaaactgaggcacagggaagttgcatgacttgcccatggtaataaaaccaataagaagtagaactaatatttaaacccaggcctgaccataaagcccatgattttcccactatatcatgtaaactttgccgaggtgtttaattgtgcataaagggttggcttaacccatagttaaaatgaaaatatgcataccaaaattgacttttgatttcaacagaattttaaatatttttagcaatcagggaaagaaaaatcattttaaactgcctgtaagaaaaatttgatgacacaaagagtattcttttggctgaaaagatgatggaaattaggacgagggatcaggaattatttaaatattttgagt

SEQ ID NO: 88583 - DNA, 1884 bp, Homo sapiens
actccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacgtcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcacagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggtttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaataccacacatcacgcgggattgtgcgggggggggcataaaatactcgggcaacacgggagggctgagcgcagggaaaatcctggaaacccacgaaggatgtgactgtaattggccatgcgcacaacctggaacaagacaagcctgtccaagaaaaatactggaaagtatgccgtaggctcttccacggacttg

SEQ ID NO: 88584 - DNA, 1267 bp, Homo sapiens
gtttattgtgtactttatttctattcttatcacattataatatataatgaaataattatacaacttatcataatgtagagtcagtgggagccctgagcttgttttcctgcaacgagatggtcctatctgagggtgatgggagacggtgacagataatcaggcataagattctcataaggagtatgcaacccagatccctgacgtgcacagttcacaatagggtttgcactcctataagaatctaatgttgccactgatctgaccgggtggagctgaggtggtaatgccagcaatggggagtggctgtgagctatgtgggaccagaggtttttcaccatctccatggtgacccaagggggaaagtgatgtgctgcaggtttccgggctggctgatggtcagggtcagtactagactgcaggacccctgactcagaccaaggcattccccactgtgtgttacagggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggtttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaataccacacatcacgcgggattgtgcgggggggggcataaaatactcgggcaacacgggagggctgagcgcagggaaaatcctggaaacccacgaaggatgtgactgtaattggccatgcgcacaacctggaacaagacaagcctgtccaagaaaaatactggaaagtatgccgtaggctcttccacggacttg

SEQ ID NO: 88585 - DNA, 1126 bp, Homo sapiens
gtcctggatgtgctgagcatggacttcctggagtgacctcactgggagggggtggtggcagcaggtccagccgtgccctacggaccccgtggggagccctgggtgtgggcttctgagttggctctttgccttcctaaggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggtttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaataccacacatcacgcgggattgtgcgggggggggcataaaatactcgggcaacacgggagggctgagcgcagggaaaatcctggaaacccacgaaggatgtgactgtaattggccatgcgcacaacctggaacaagacaagcctgtccaagaaaaatactggaaagtatgccgtaggctcttccacggacttg

SEQ ID NO: 88586 - DNA, 232 bp, Homo sapiens
aacatagccctttgggagagttgtgtccaccaggtacattctaagactgatctctaatcctttacacctctcttttccttaccctatactatatacaaaaattatctcaaaattcatcaataacattccttttccatgttcttcaagttttctgtttcctacagtttctggttcttctattcaacagatacttattgatcctttgccaaatccaaggttatgaagctttatc

SEQ ID NO: 88587 - DNA, 824 bp, Homo sapiens
cggggtccccggggccaggcaggagcgacccgggcctggaggcagcagagccccctcccgcaggaggctgggcccggggactccaccccgttggctgctgcctggcgcgtctccctcctgcccacacctcacgatgtatcgggaagtttcggaatcgatagagctcaagtcgtacctagctcagctgcaaccatcaaacttcatgatcaatcaattggcacacagcaatgggaacatagccctttgggagagttgtgtccaccaggatctcatagatcagaacgtcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcacagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggcggggaccccaagtgcatggccagggtggtgttctggcgcctggggtctcctacgagggcctggggttggtggacatgctccacagagatctgggccagcagactcgtggtcacttcggctctggcgccatgggagcccgagcggagcttgccgcg

SEQ ID NO: 88588 - DNA, 1870 bp, Homo sapiens
agctgtacgctcggattacgggatcgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacgtcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcacagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggtttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaataccacacatcacgcgggattgtgcgggggggggcataaaatactcgggcaacacgggagggctgagcgcagggaaaatcctggaaacccacgaaggatgtgactgtaattggccatgcgcacaacctggaacaagacaagcctgtccaagaaaaatactggaaagtatgccgtaggctcttccacggacttg

SEQ ID NO: 88589 - DNA, 1123 bp, Homo sapiens
acaatctggccaactcatttcacagtataaatcactcctgcagggaggggttcccctcggcaggcagggcacgtgctggctcaccccacgtccccctgtaccccctttgcagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttc

SEQ ID NO: 88590 - DNA, 2473 bp, Homo sapiens
  misc_feature (20)..(20): n is a, c, g, or t
agcgggccgctctgcgcggngcggtccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttctttttgtttttttcttttttttgtcggggcaggatggagttttgctctttgcccaggctggagtgtggtggctcgatctcagcttactgcaacctccgccttccaggttcaggcaattctcctgcctcagcctcccgagtagctgggattacaggtgcctgccaccacacccgctaatttttgtaatttttagtagagacaggatttcacaatgttgtccaggttgatctcggactcctgggctcaagtgatcctcctgcctcagcctcccaaagtgctgggattacaggcgtgagccactgcacctggcctgtttgatttttttccaccaccacccctaacctttgctttttaaacctgccggtccacctggacacttcacagggtcagaccaggtctagcccttgctggcactggggacacagagaccccctggccccagttcctggggatgggccctgccttaactcttggcgctgcggggaggcgggtagcctcagggacctggagccttttggcttctgggagtttacctctgagggaggagggcgcttctgatcttagggagcgagaggccggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttc

SEQ ID NO: 88591 - DNA, 2277 bp, Homo sapiens
  misc_feature (20)..(20): n is a, c, g, or t
agcgggccgctctgcgcggngcggtccgcccccgtcgggtgtttgtggtggggctgcggagtcgccgatcccgccggaagcgccaggacaatggggacccgggacgacgagtacgactacctattcaaaggtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttctttttgtttttttcttttttttgtcggggcaggatggagttttgctctttgcccaggctggagtgtggtggctcgatctcagcttactgcaacctccgccttccaggttcaggcaattctcctgcctcagcctcccgagtagctgggattacaggtgcctgccaccacacccgctaatttttgtaatttttagtagagacaggatttcacaatgttgtccaggttgatctcggactcctgggctcaagtgatcctcctgcctcagcctcccaaagtgctgggattacaggcgtgagccactgcacctggcctgtttgatttttttccaccaccacccctaacctttgctttttaaacctgccggtccacctggacacttcacagggtcagaccaggtctagcccttgctggcactggggacacagagaccccctggccccagttcctggggatgggccctgccttaactcttggcgctgcggggaggcgggtagcctcagggacctggagccttttggcttctgggagtttacctctgagggaggagggcgcttctgatcttagggagcgagaggccggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttc

SEQ ID NO: 88592 - DNA, 1612 bp, Homo sapiens
  misc_feature (20)..(20): n is a, c, g, or t
agcgggccgctctgcgcggngcggtccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttc

SEQ ID NO: 88593 - DNA, 2458 bp, Homo sapiens
  misc_feature (20)..(20): n is a, c, g, or t
agcgggccgctctgcgcggngcggtccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttctttttttgtcggggcaggatggagttttgctctttgcccaggctggagtgtggtggctcgatctcagcttactgcaacctccgccttccaggttcaggcaattctcctgcctcagcctcccgagtagctgggattacaggtgcctgccaccacacccgctaatttttgtaatttttagtagagacaggatttcacaatgttgtccaggttgatctcggactcctgggctcaagtgatcctcctgcctcagcctcccaaagtgctgggattacaggcgtgagccactgcacctggcctgtttgatttttttccaccaccacccctaacctttgctttttaaacctgccggtccacctggacacttcacagggtcagaccaggtctagcccttgctggcactggggacacagagaccccctggccccagttcctggggatgggccctgccttaactcttggcgctgcggggaggcgggtagcctcagggacctggagccttttggcttctgggagtttacctctgagggaggagggcgcttctgatcttagggagcgagaggccggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttc

SEQ ID NO: 88594 - DNA, 2175 bp, Homo sapiens
ctgccgcgcgcctactaccggtggacccgcgcccacgacctgcgcggcttcctcaacttcacgctggcgcgagccccgtcctccttcgccgccgcgcacaaccgcacgtgcaggtatcgggctttccgggatgacgatggacattattcccagacctactggaatcttcttgccatccgcctggccttcgtcattgtgtttgaggtagccgaggcacctgctggttctcccatccatggcatgaggccccgaccctgtgctttgcctaattcgagcacgtggtgaggggtcggtgccgtcacttcctgctgtgtcatcttggtcaaatcagagctcttctctgcacctgcgttttccctgcctggcctcatccctgggttgtggtgtggacattgtgggtgtctccacaggagccccagggccacgaaagctggggtggcctctgccccttctggggttccttttcctgcacagctgctttctgactccacccacagctgggagcaggtgccggagccccggcctgcctggccctgtgaaggccactctgggcgtttgggtgggcgtgagtgccttcctctgctcccagcatgtggttttctccgttggccgcctcctggacctcctggtgcctgacatcccagagtctgtggagatcaaagtgaagcgggagtactacctggctaagcaggcactggctgagaatgaggtgaactgtacagcccagtctcggccctccccccagccctctccctatccttgccagtggctgctctacctccggacactgagtcacatccctcttcctcttgctgcccttttttggggacaggttctttttggaacgaacggaacaaaggatgagcagcccgagggctcagaggcaagtctgggagcagccaggcccctgccccgtgcactccctgaggtcacagggccctgcccagccgcccactgtgcctcgtggccatggcctgctcctggccctagtctgacttgtccctgcccccaaccctctccccagctcagctcccactggacacccttcacggttcccaaggccagccagctgcagcagtgacgcctggaaggacatctggtggtccttaggggagtggcccctcctgagccctgcgagcagcgtccttttcctcttccctcaggcagcggctgtgtgaaccgctggctgctgttgtgcctcatctctgggcacattgcctgcttccccccagcgccggcttctctcctcagagcgcctgtcactccatccccggcagggagggaccgtcagctcacaaggccctctttgtttcctgctcccagacataagcccaaggggcccctgcacccaagggaccctgtccctcggtggcctccccaggcccctggacacgacagttctcctcaggcaggtgggctttgtggtcctcgccgcccctggccacatcgccctctcctcttacacctggtgaccttcgaatgtttcagagcgcagggccgttctccctcgtgtcctctggacccacccgccccttcctgccctgtttgcgcagggacatcacccacatgccccagctctcggaccctgcagctctgtgtcccaggccacagcaaaggtctgttgaacccctccctccattcccagttatctgggtcctctggattcttctgtttcttgaatcaggctctgctttccccctagccactacaggcagcctctgacagtgccgctttacttgcattctgcagcaattacatgtgtccttttgatccttgcccaacttccctccctctcccagctcctggcccctggcccagggcccctcttgctgtttttacctctgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtgtggccgtctgcttgctaaaaaatggatctgtgctcatctgtattgatgtccttggagttctacaagtggaacttaagtgtcaaaaagaatatgtggtttttagct

SEQ ID NO: 88595 - DNA, 2352 bp, Homo sapiens
ttcatggagtgcaacatgtaactttatattagaaaatggaatgtcacatctttaccatgggacagagacacaggaagatgtcaaagtctgaaatagcaagtgaagctgaatgtagcttatgatagggagggagggctctgctggacagggacagtctctgagcaggtgaactgctgatctcacagaggtcagcaatcggcggattttcaccgtgtaagtagactgaagtcatccgtagaagcacagacgtactggactgtcacatctactagaaaataaagcatctgccacctggggggtggggagggtccagtttagcccaatgggggacaacccagcacatccacctttggaacccaccagttaaaggtattgtcagagtatcctgtttgggaagaattcccatttcaggcaccctcgatgaagagccaggccaggaacatgggatgagagagcgaaatggtggaaaaaggggagataggctaattccagaggcacctgcccagccaacactcagccctggctgcgcgcactgagtcctgtgtctgctgcaggtatcgggctttccgggatgacgatggacattattcccagacctactggaatcttcttgccatccgcctggccttcgtcattgtgtttgaggtagccgaggcacctgctggttctcccatccatggcatgaggccccgaccctgtgctttgcctaattcgagcacgtggtgaggggtcggtgccgtcacttcctgctgtgtcatcttggtcaaatcagagctcttctctgcacctgcgttttccctgcctggcctcatccctgggttgtggtgtggacattgtgggtgtctccacaggagccccagggccacgaaagctggggtggcctctgccccttctggggttccttttcctgcacagctgctttctgactccacccacagctgggagcaggtgccggagccccggcctgcctggccctgtgaaggccactctgggcgtttgggtgggcgtgagtgccttcctctgctcccagcatgtggttttctccgttggccgcctcctggacctcctggtgcctgacatcccagagtctgtggagatcaaagtgaagcgggagtactacctggctaagcaggcactggctgagaatgaggttctttttggaacgaacggaacaaaggatgagcagcccgagggctcagagctcagctcccactggacacccttcacggttcccaaggccagccagctgcagcagtgacgcctggaaggacatctggtggtccttaggggagtggcccctcctgagccctgcgagcagcgtccttttcctcttccctcaggcagcggctgtgtgaaccgctggctgctgttgtgcctcatctctgggcacattgcctgcttccccccagcgccggcttctctcctcagagcgcctgtcactccatccccggcagggagggaccgtcagctcacaaggccctctttgtttcctgctcccagacataagcccaaggggcccctgcacccaagggaccctgtccctcggtggcctccccaggcccctggacacgacagttctcctcaggcaggtgggctttgtggtcctcgccgcccctggccacatcgccctctcctcttacacctggtgaccttcgaatgtttcagagcgcagggccgttctccctcgtgtcctctggacccacccgccccttcctgccctgtttgcgcagggacatcacccacatgccccagctctcggaccctgcagctctgtgtcccaggccacagcaaaggtctgttgaacccctccctccattcccagttatctgggtcctctggattcttctgtttcttgaatcaggctctgctttccccctagccactacaggcagcctctgacagtgccgctttacttgcattctgcagcaattacatgtgtccttttgatccttgcccaacttccctccctctcccagctcctggcccctggcccagggcccctcttgctgtttttacctctgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtgtggccgtctgcttgctaaaaaatggatctgtgctcatctgtattgatgtccttggagttctacaagtggaacttaagtgtcaaaaagaatatgtggtttttagct

SEQ ID NO: 88596 - DNA, 1564 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgca

SEQ ID NO: 88597 - DNA, 3672 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggt

SEQ ID NO: 88598 - DNA, 3732 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttttttttaaaaaaaaaaaccccaaaaaacccccaaaattttgaaggttttttgggggggccggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggt

SEQ ID NO: 88599 - DNA, 3692 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacatattttaacttcttttctagctgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggt

SEQ ID NO: 88600 - DNA, 1624 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagataccaaggtataaaggacaaggtaagaagaagacaagcgggcagaaggctggtgacaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgca

SEQ ID NO: 88601 - DNA, 589 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcggtcttaccaaaggataggttggggtctgtcttagtctgttcaggctgccaagtaccatagattgggcagcttacaaacaacacatttttcctcacagttctgg

SEQ ID NO: 88602 - DNA, 3795 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattagaagaataaatgttccctgagctgcccggattcttgttccgcacagtgccctggagtcctggtaactgagttgctggttgtgctgccatctgctctttgtgcgtcctggttgctggctggccaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggt

SEQ ID NO: 88603 - DNA, 4217 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggtgaggccggaggctggggccgggcctggcggatccgcagggcttgcgtggacagcgggcgtcacaacggtcgcggcgaggaggccgcctccctggcgagggaccggggccggcgggcactgggggcgcgccccggcatggcctccgtcctgcccgccccacagagggggtcggctcgttcgttcgtgtggtcccggagggcaccgcggactgggggtgcctggcccatcccctgcctcattccgtgggggcgggaccgcggggcttgggggccacacgggcggcccgcagctgggccctggagtgcggccccagcgtctcttcctcaggctcgggcatgatccgcggcgggaaagcagcgcgtccagccgaagcctgggggtcggagagcttgtgtgactgagaacgtttcggaaggcgtttctgacctttgcacctgccctcccagctcgttggcttgctcgtgtttgttgctggataaatgtgagcttgttgtgaaaattgtcttgaaattataatttcctgtttcttaacttttttttaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggt

SEQ ID NO: 88604 - DNA, 1264 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaagtgcccaaagatgtggacttcaatactcgggatattttttctctaattaaatactatgtgattattgttgattttttttcccaggaaaatcactaaaataacctatcattttatcactcagagatatttcctgttaatattttgttgtgttttgttacttctaaggtggtcctattttatatgttgttttgtattctggcccttcctatacctatataccatcggaatacttttgggaagttgactttttagctgatttttattatctatagaaataaaatttttaaatcatctctccttttttggacatttacaa

SEQ ID NO: 88605 - DNA, 288 bp, Homo sapiens
ccactccctggctaatttttaaaaattttttgtagacaagggtttcactttgttgcccaggctggtctctagctcctggcctcaggtggtcctcccgcctcggcctcccagagagctgggattgcaggcatgagccacagtgcccaggtgatacccctatcatttcatctcaaccatttagctgcacccatcctctagctccacgcctaccagattgtccataaaaaccctaacctgcaagcctctggggagactgatttgagtaggaactccatctcccacggggct

SEQ ID NO: 88606 - DNA, 702 bp, Homo sapiens
tcttcagtgtagcatccaactcttaagaatttcaagcctaaataagaattagagccacttggaggtagcgacagatggggtgaggcaccaaattaatgtgattcatggagaatttaatctaaaagagaactggatgatgagcagagccagtactcatccagtgccacccatccatcacaccatctttgcaccatagcacctgtgcatcacatgattcctatgccacgccacctgtgtgccataccacccacacaccacaccacccatgcatcacaccacctgtacatcacgccgcctgtgcaccacactgatcgcaaatcacaccacccgtgcatcacaccacctgtacatcacgccgcctgtgcaccacactgctcacaaatcacatcacactgcctgtgcaccacactgatcgcaaatcacaccacccctgcatcacagcacccatgcatcacaccacctatgcatcacactgcctgtgcaccacatagtttatgcaccacatcacccgtgcatcacaccaccagctctcctgccctcagctcagtgctggggccacattgttacggggttttgaatatgaatctttaaattactcaagtttgtgctgctgttgagaaaaggcagaatgcacccttgggcagttctcccattcccgaacccacccacatgtctgcctctcaacacttgctcagctgacta

SEQ ID NO: 88607 - DNA, 395 bp, Homo sapiens
ctttaggttgcctgacatttgtagctgagtgaaaccatggtgagcattgatttattttactataaaattatcagttttactcactcaaacaatccttttatattaaaaatattttaaaaataaaagcagggtattgttttgctttactaaatggagtcacctctttttctcttacttttgacaatttggttgtcaaattgtgtgaattgtgaaaaaatagccctgagtacagagaatttttacctcagggatatcaaaaaagtcatgttagtaataaaataagccattgattgtgttaaaactcaaggtgggtcatttaattgcagttattaaaaagttctttcattatttacctctgggagagactgtaggtaggactgtaagattattaatga

SEQ ID NO: 88608 - DNA, 437 bp, Homo sapiens
gcagatctgtgtagctgagtccggatccctaaagcattactgtaggttgagtatattgggggcaaactgaaaatatatacagtcagcttacagtcatttctgctgacttttctaagtgctcccttacatcatttagcatttgggatgtttgcattagaattgaaatagagaattgtctagtccattctcctttgcttttggagactttaggggagattgcacttgcacaactggtattttggcgggggtggggggtgtattttgaaatcattgttctataaccagtgtgtcattgttactcagcctgtctaaagaatcacttctggctgagatttatatccattttattttctctctggcaaaaattcaagtggctcttcttccagcttttttttctccccttctctagcttaatttgtcagttccattcttaaaca

SEQ ID NO: 88609 - DNA, 350 bp, Homo sapiens
catgcagaaaaatatgagggtcaaaaagttaggaagttacccctggaccacgaacatctgcccattatgtttgaaagttaaagggggtgtttaccatctatattgtacagtctttgaaagtttagattcagttcttatttttttctttcatatcctaccagaataccttaaatatagaaggcaccccaaaagtatttcataatttaatccacagcaagaataaaatatccatcttctatagtgtgtaattgctagaccctaaaatagtacaataatattggccctagagctgttcttaatttcatgtaattatagcttgtttcaaaataaagtttgtaaagtcttagaat

SEQ ID NO: 88610 - DNA, 229 bp, Homo sapiens
gatcctcctgcctcagcctcccaaggtggtgggattacaggcataagtcaccctgcccagtcctgtttttaaatttaattttaacattttgtttattatttttgagacagggtgttgtcgtgtcccccaggctggagtgcagtggcacaatcatggcttactgcagcctctacctcctgggctcaagttagcctctcaccttggctgctgagtagctgggactataagc

SEQ ID NO: 88611 - DNA, 449 bp, Homo sapiens
acccatttcagttatatcacccttgatccacactgcttcagtttgaggcccttgaagattgatggctgatgaagcacctcttggcaaatttacattctttgtgttccctgaagagatggcagagaggatccctagcatgatcccagatttctcactttctctggagccttcacaagttatgccttgtgtttctcttatttttactgcacataagcccttccttgcaggatgaggctcatataagcccacctccaaaaaacacttcttaggaatcttaagaaaaaattagtataaggtggctttgaagtattttcattcatcttcttcacttttcccagattccaaaggtacatattattccacattagatattgccatcatctctaattgctccactccccaaatccctcactcaaacagcccaatcccaattcacatcttcctcttct

SEQ ID NO: 88612 - DNA, 262 bp, Homo sapiens
taagtcactatttttcattggaaggtctttcagtataactgtatttcttttattttttaaataatatcaagaataattatttaaaaatatcagattgttttatttttctaaactttttttttgggagggtgctgttttaaccatttgttgtgtctactgatactcccttttggtaagtgaaaagtcctcaggtgatttgtaaactttgtgagttaattttcagcagaagtctgtttttctgtaacagccatatgtgttgtag

SEQ ID NO: 88613 - DNA, 918 bp, Homo sapiens
ctgtctgtgacccagatgccactctgtcctctccagcttagaggcaccctcctcagtgctttgtttttgagaggaggcctcgctctgtcgcccaggctggagtgcagtggtgccattatggctcattgcagcctcaacctcctgggcttaagcaatcctcctgccttagcctctcaagtaggtggggccacaggacacaccatcatgcctgggtaattttttcattattttgtagaggcagggtcttgctgtattgcccaggctggtcttgaactcctgggctcaagtgaccttggtgctttaagtcagaggtagccaggtagcctggggcagtgaagagaactctgatctgtatctcaggaaaccgaggttctaggctctgcgtgaccttgacacctcccctccatgggccttggtctctccccaacagtaaaaggaggcagctaaatatgattaactctgaactctcccacctgggatattcagggaagccaagaagaggttccaatctggagcaacagttatccccaagagggcactttccacagaagacagggatctgctgacatctttagttgggcagaggaccctgcccaaggaaagaaaatatttccccaaattaccctcgtgtagtgaagggagggtatagctttgaatcagactgcaggcctgccaacttgttaactgtgagcttgggcagtaacaataacattaaaaataataatgtaacaattatggcagcggatagtgggagaatagtggcataatagaactagctttgggctgggtgcgttggctcatgcctgtaatcccattgcttttggaggctgaggcaggaggattgcttgagctcgggagttcgagaccggcctgggtagcacagtgagccctcatctcttaaaaaagaaaagaataaaa

SEQ ID NO: 88614 - DNA, 418 bp, Homo sapiens
tcagaatacctgttcatttacaacccaactccgcgctacagaagtgactgctccccagtctttcactctgaaactcccatgataacgatccagtggtcctgtctctgtggctctgtgcctttgcctgtaccacatctggaatgccttcctgggtcaaaataattgtcgcgatttgagtataagcacattatctaaggcttctaggggaagcaatacaattaaaagcttgatcagtttgtggggcggtggggggagagattatataagagctctgctgttagtgacttacacacacacacacacacatacacacacacacacagagtgtgctttcatatctatttttctcctatcctaagcttttcttcttattctttggtgagctccctgaaagcagaaatattttattctttttcaa

SEQ ID NO: 88615 - DNA, 1572 bp, Homo sapiens
  misc_feature (1)..(1): n is a, c, g, or t
  misc_feature (6)..(8): n is a, c, g, or t
  misc_feature (12)..(13): n is a, c, g, or t
  misc_feature (20)..(20): n is a, c, g, or t
  misc_feature (25)..(25): n is a, c, g, or t
  misc_feature (94)..(94): n is a, c, g, or t
  misc_feature (100)..(100): n is a, c, g, or t
  misc_feature (190)..(191): n is a, c, g, or t
  misc_feature (203)..(203): n is a, c, g, or t
  misc_feature (276)..(276): n is a, c, g, or t
  misc_feature (278)..(278): n is a, c, g, or t
  misc_feature (286)..(286): n is a, c, g, or t
  misc_feature (338)..(338): n is a, c, g, or t
  misc_feature (344)..(344): n is a, c, g, or t
  misc_feature (353)..(353): n is a, c, g, or t
  misc_feature (368)..(368): n is a, c, g, or t
  misc_feature (374)..(374): n is a, c, g, or t
  misc_feature (393)..(393): n is a, c, g, or t
  misc_feature (397)..(397): n is a, c, g, or t
  misc_feature (401)..(401): n is a, c, g, or t
  misc_feature (419)..(419): n is a, c, g, or t
  misc_feature (425)..(425): n is a, c, g, or t
  misc_feature (431)..(431): n is a, c, g, or t
  misc_feature (437)..(438): n is a, c, g, or t
  misc_feature (455)..(455): n is a, c, g, or t
  misc_feature (603)..(603): n is a, c, g, or t
  misc_feature (617)..(617): n is a, c, g, or t
  misc_feature (632)..(632): n is a, c, g, or t
  misc_feature (656)..(656): n is a, c, g, or t
  misc_feature (698)..(698): n is a, c, g, or t
  misc_feature (718)..(718): n is a, c, g, or t
  misc_feature (735)..(735): n is a, c, g, or t
  misc_feature (796)..(797): n is a, c, g, or t
  misc_feature (809)..(809): n is a, c, g, or t
  misc_feature (877)..(877): n is a, c, g, or t
  misc_feature (901)..(901): n is a, c, g, or t
  misc_feature (1000)..(1000): n is a, c, g, or t
  misc_feature (1017)..(1017): n is a, c, g, or t
  misc_feature (1031)..(1031): n is a, c, g, or t
  misc_feature (1041)..(1042): n is a, c, g, or t
  misc_feature (1051)..(1051): n is a, c, g, or t
  misc_feature (1063)..(1063): n is a, c, g, or t
  misc_feature (1114)..(1114): n is a, c, g, or t
  misc_feature (1244)..(1244): n is a, c, g, or t
  misc_feature (1297)..(1297): n is a, c, g, or t
  misc_feature (1335)..(1335): n is a, c, g, or t
  misc_feature (1346)..(1346): n is a, c, g, or t
  misc_feature (1355)..(1355): n is a, c, g, or t
  misc_feature (1378)..(1379): n is a, c, g, or t
  misc_feature (1392)..(1392): n is a, c, g, or t
  misc_feature (1430)..(1430): n is a, c, g, or t
  misc_feature (1441)..(1441): n is a, c, g, or t
  misc_feature (1485)..(1485): n is a, c, g, or t
  misc_feature (1487)..(1487): n is a, c, g, or t
  misc_feature (1561)..(1561): n is a, c, g, or t
  misc_feature (1572)..(1572): n is a, c, g, or t
naaaannnaaannaaaaaanaaaanaaaaggaaaaaatgaaaaagaagccattgaataccctattgaccataagaaaaaggcagggaaagttgntcaacngcaacccaggcactgaaggaaaaagaacatggagaatgacaaaagcccagagggaggagtaaaaggacacaaacaccattctcagggacnnggactgggcgcngttctcagggaccaggactgggcactaatcacagaactgtaacaggcgccccatgggaatgaccaactgttananggggcctncagggcagcacctccctcctgcctcccaccaacagcttctaaagggaaatgncgactnttttcacancagtcccctcactgnggctgngtgtgtgggcgcagatganaggncacnacaacctgattcagtccncactgnggctgngtgtgnngggtcagatgacaggcnaccacaacctgattcagtccccactgtggctgtgtgtgggggtgcagatgacaggccaccacaacctgattcaggattcagttggctaccagccagtgccataaggaaaaccattctggggctcttgagaggggcaaagcataatttncatgtgggagaaangttaatagtttgtgnccagaggacaagctgtggtttatnaaagactgctgcaggttcctactatgcttctcatcaagaggnggaatctaatcaccttcccnccttgaatcatggctgntctcagtgatgagtacgactggacagtgtggcaggagagatgctctgggacttctgagggnngatcatgagagnccttacagcttctgcctgggcctcttggacacacaccctgggagaagccagacaaacctgactacctnactgccagactgggaggaagtccntgctggccacaaagagagggctgggtgcctgctccatgtccccagccactagagtccttctgggtgcctgcttcacgtccccagccactagagtccttncagatgagaccaggganatcatgaagcaacnaacccacacnnccctgtccngtgtcttgaccnagaaaattgtgacatgtaaaaagaataaattcctggtttaagccagtaagnttactggtacattgttacatctcagataattaaaaccttgaaaaactcatgagagatcacaagtagaaccttgatctgaaacatggcatgtggcgatttatattgagtattaggttaaaaatgcaagaanggagcatagttaatattttacgttaaagctaaaactataattgcctacttaanattttcagtaattaggttgtcactttttgttcttaacnaagaaatcaantagttttantccataaacagttagaactgatnnacacatccgtttntccttactcattttaaacagctatctgaaataggaagngtaatataatntttaaagaatctgaaaacatgacagaaatgtttaaactataaananatattgtatatgttagcatattgtatacattgcatattaacataagctagaatcattgacataaatttatatanacaaaaggtan

SEQ ID NO: 88616 - DNA, 419 bp, Homo sapiens
caaaccatatcactcttcatctgctacgggtgccattccctgtttctacagtgtcctgtttgctaccttctttgtagatttctattcattcatcatgtcccagtttacctgttacctcttcaacagattattcttcagtctgtccctcccaaactccaccaatgaacattctttgttcagcccattattgttaatatgcacttcactgaaaacactgttttatgcttgtttacatcccatctctgcagggctctgagcctatagtcagcagttgggaacttactaggcatagcgcccagtaaaggatagctctttatatatatatatatattttttttttttctaaaataataagccccaagaaaaacattacctgtgaaaaacaaatgatatttttataccattttcaaaacctaata

SEQ ID NO: 88617 - DNA, 352 bp, Homo sapiens
aaggtttcatgatgttgttgcccttccctaactcaccctcttgctcaaaattgggcttataatagaatgtatggaatgatccagaaatgctttgagtactacatgatttctaaaagaacagaggccagatgaagatggagagtttatgaaaggagactcattatcctgctctgtgctttccctatctttcacacagtaacacacagaacagggggaaatatgtatttgtattttatctaattagaccttctgattctgtttcttgagagagaatgaatgcaccaaacatccatcgacaacagaaaaactccaacttcctttatttttatccagccatgcctccttttatgaa

SEQ ID NO: 88618 - DNA, 354 bp, Homo sapiens
ttgaatcttcctagtttcagatcttcattaattcttttaagtgatagttttcatttttttcactataaatttcctattgggtgattaatagtaaagtaagtaaagataaaagattatttttattggcatttatcttatgcctacataaaatttgctttatcatattatcacaggtctacaaagtttttttctagtcgtttctaacttaagttcactagctgcacatgggcatatgtgcctgtacccagctactcagaatgctgaggtggagggattgcttaagtccaggaggttgagcctgcagtaaaccatgattaggccactgcactgagctggggtgaaagaatgagacct

SEQ ID NO: 88619 - DNA, 564 bp, Homo sapiens
ctccatcttaaaaaaaaaaaaaaaaaaaaaagaacagttgttacctttgggtaaccactagaagaggacgctggaggaagggtttgggggtgaagacactgttctctttctttctttgggtgctggtcacaaaggtcggttcagtttgtgaaaattcatcaagccattcatttctaatacatgcgcttttctctatgcgtgttatccccacagataagctggtaaatgtttaacttgcaaaaaaaaaaatttgttttaattaaaaagcccttaattgtagcatttgtcaattcctgtggtgtaaatatttctaccatggttgattacatgctacgaatgtggtgtcaattctgagttgggcaaagagacatatgattggttcttgcaagctcagttgagccagctccaggagaccattggttatacttcaacaaagagatcttttgaaaagtaaagtcttctaaaatgagaggtgaaactgaatgctggacggggtaagttccttcttgcttggtatcctgctagcacacccatcacctacttccccacctctctttactcttc

SEQ ID NO: 88620 - DNA, 206 bp, Homo sapiens
gaagaaagtgagatggacaaggggtgctttaggtaggtcaggaaacagacatttcctgagaaacatgacatttacactgagacctgaaggatgagatggagctaaatgtgaagcatgggggaagggctttccagctgaaggaacatgtgcaaaggccctggggcaggggcggatggagcatcctggttcgtctgagaaactgagat

SEQ ID NO: 88621 - DNA, 310 bp, Homo sapiens
gcatcaccagaagccaaacagatgctggtgctatgcttgtgcagcctgcagaaccgtgagccaaaaaacctattttctttataaattacccagcctcaggtattcctttatagcagtgcagatggaataacacacttgtacagccacaaatctgctccccctcttcctacttattcctatcttttttgcatcttccatcctccccatctccaaaacatttagggagaaacaaggctggcgtctgctgggtagcagtctgactgattatcaggcttagcctgatcaggagctgttggcattacacaccaca

SEQ ID NO: 88622 - DNA, 290 bp, Homo sapiens
gtagaatctttccttcaatcttcaaatgcatttacgtcttctctgttacaaagcaaatatttaaatgttaaataaaacaatacacactgcaacttactttgatctattttttaaaatcaacattctaaaagtattatttatggataatataatgcacttattttaagcacagcttagtttttgtgacaaacatatatgtttatataaccactaacacaatcagtatttaattaccacagaaagttctttaatgccaatctgtagtcaatccccatctgaaaccctgccag

SEQ ID NO: 88623 - DNA, 418 bp, Homo sapiens
taggcatttaattggaaatctatttatgttttcctaattattttgcaatttttttgtatttttgtaaggtgttatattttctcacttgtcaagcagtagccattatattctatgccctgttcaaacaagcattacaaatacaaaaatcgatacttcttaaagttcacttaaacttctgtgctcataacttactatttcatttttgtcaattaattacccatttcttaccttagccagactgtagagcttttaaaatggcagaggttttgttcttgttatttttcttttagataatttaaaagtttattgatattttagacatattttatatttttaatcacataaaataggtacaatcattgcatataattatatcagaacaacgataagtcagctttctttgaaaatccatagacta

SEQ ID NO: 88624 - DNA, 294 bp, Homo sapiens
  misc_feature (1)..(1): n is a, c, g, or t
  misc_feature (219)..(219): n is a, c, g, or t
  misc_feature (283)..(283): n is a, c, g, or t
  misc_feature (285)..(287): n is a, c, g, or t
  misc_feature (290)..(291): n is a, c, g, or t
  misc_feature (293)..(294): n is a, c, g, or t
naccaagaactcaaatccctattgggactcaggtggtcttgtagctgccctttgcccccaggatctgaaaaaaacagccctgcagactgaagccggaaaacttgatataaacttgaaagaactcagaaccacaacagattctccaggggcagcctttgtgcctggagctgctgctacacaggccgcccaggaagacccccctccagctcctgcatgccncatgctctctccagaaagtaaccacaactgggataccaatgcctatgccatcatcacagacttnannncanncnn

SEQ ID NO: 88625 - DNA, 3513 bp, Homo sapiens
tgcacacctgtaatcccagctattcggctgaggcacgagaatcatttgaacccaggacacggagattgcagtgagccaagatcacaccactgcactccagcctgggcaacagaacgagattctgtcttaaatgaatgagtgaatgaatgaagtgaattacaaaaaattttaaaatacaaaccaaatgttttgttaaattcaacagacataattatgtgtcagctgcatgcagtggctcatgcctgtaatcccaacactttgggaggaattacagggaccaggagtttgagactagcttggccaacatagtgaaaccccatctctaccaaaaaatataaaaattagccaagtatggtggcatatgcctatattctagctactcaggaggctgagatgggagagtcgcttaaacccaggaggtggaggttgaaatgagctgagatcatgccactgcactccagcccaggtgacagagggagactctctcaaagaaaaaggaaaaaaaattactgtgtctaatttctataaaatttttttttttacttattctcaatttctgtacttgtggatcagtagcaaacttcatggactggcatcagtatgaatgacatttgagtagcactgtttggtgtgcagcatactagagtagtgagagaaggaaacatctgtggacattgtatcaactgggaggccaccgaacattttgtcatgtttgttgaataacttatgcagcctaaggcagcctgtcagggcagtggtgtggcaaagccataatatttgtatggggctcattctactgagaggcatatctgctgttctgatagtgtagtctcctccatttttcctccagcactctgctctttgggaggcactgcagggtggctgtgactttggtcaggtgtagcttatgtttggccatctcttggttgatccagtttatttgtcttagtttcagtgatggccagagggttacaaaggatttggaatggagcatgtctcagggtgatgtgaactctgttgttgcctggatttccagatcatgtgacagagaatcagctggatcatttcagctgtccaggttatcagttagaataaagtttttaaaaactaaaatcttgggagcaaggaggcctctctgatgtaaagaaagatgagtagactggtttatcccttctatgcagttagtacatgagagtaccctggtcctttaagagccagagttctttggggtttttgtttgttttcccccattaaaaagcactagcatttattaggggaaaatgaggttctcctcaactcatgttttccctctctgtattgtggaaaatctgaacctcactctgaaagtgaatacatccatttgaaagggatggcaggttaccaagagtgtcatttaatgaaacccctctttttcttgaccaaaagagaccttgttttctttgagaagcaggagttcactttaatttttatgaacatctcacaccacttccacctaaccctacctactgtaatatgggctggcctgtcaagtcttgggcaagaatagtgataagatgctatcaggtcagaacccatattgttagagtagctgaaagattcaggagttcttattttgaactcttgcatgtagaatcattacaagatgtctcttaaatgcagttagagtgagaggaaagctggagctgtgggtggggaacatgtcagaggtggggctcagcaggaagtgggaccagtgcctgctggatgtggtagataagtaccggttttggattagggattgttttctcacttaccttctttaaaaaaagaatgtggccattagcctttggttctggcatggcattaggaatggcttattccagcagtcagcatgatttccaggttccatgtcttctacatggaaaacatgtcaaaggacaggagcagtgaccacctgacaacatcgcagtgggaggaaaagagaaatcatgtttattcctcaggaatgctgaagtaccctggagtaagctgtcattcttattataacaatgttattagtaatgctttaaactccagcacacttgttatgtatttgaaaccaagtctgtttcttgttttgtattttctctctggaaattgtaaggcggtggtcttaaatacattaaacaaaaataggaaaaaaagcagttaaaatttgatggcatatcagccagctgacccaattcttggcacagtcaacaagtatctttgatttgttttcagcagggctaagtcatcagatatgtcagaaggggtaaaaaaaaaaaacacctgtcttttagtcatttctttgctgtcccaaaaatctaagtattatagtgagtaacattagcttgcagtttttaatagttcatcaataagtctgaatccttgtcagttgccacactggctacccagaaaatttcaggcagttatatgcctcaggcagttatatgaaggtttatttccttcttatacattaaaaatagtgtgaaacatgattgaaaatacactgttttagtctcttgattttgtatccactttcaacattttaatatggaaccttgacagagactttgctgtaattttggtcttgaggggcggggggactcatccaactcacagtacccagcagtctgagttcttcagataggcataaagaaacgagaagttacataatttttgttgaatgggtatggtgatgttggcaaatgattaagcctaagaaaaactgtttgtgtaccagcacctgtaatcccagctactcgggagggtgaggcaggagaatcacttcaacccaggaggcagaggctacagtgagctgagatcgtaccacagcactgcatcctgggcgacagagtgagtgagactctgtctcaaaaaaaaaaaaaaaaaaaacagaaaagctacaaaacattcacacattttgttgttttctatgtctctgtataaatgatgagctttaaagttaatcctcaattttaaatatacaaaatttttaatttgtacttttgataccatgcacttttggaaattttttattttttgagagcatgatacttatttcttacgctcatgtttgaaaaggtttagaaatgtggttgctaaattagttttaaaacaacaactgtgactgttttacctgtgtccaacatgttgagaactcaaaaagtagtaaatcgggctgtcttaatagtgcgcctgttactaatggaatttacttaaaaagtaagtttgccatatgaaagggtattaatatccttttcaagcataacatacaaatgaattttcatcttaaatatattaacttctgataagaaaacagatgctaggcctaaagatatttgctacataggaaaaatgatttttaaaaaatttgtctggggtgcctgtagtcccagctactcgggaggctgaggcaggggaatggcgtgaatccgggaggcgggtcttgcagtgagcagagatcgcgccaccgcactccagcctcgccgacaaagcgagactctgtgtcaa

SEQ ID NO: 88626 - DNA, 397 bp, Homo sapiens
cactttcaacattttaatatggaaccttgacagagactttgctgtaattttggtcttgaggggcggggggactcatccaactcacagtacccagcagtctgagttcttcagataggcataaagaaacgagaagttacataatttttgttgaatgggtatggtgatgttggcaaatgattaagcctaagaaaaactgtttgtgtaccagtttaaaccatgaatgtactgtaaataggttttgttgttgttgttgtttttatttttataccgctgagagtcaacacttaattcttggacatgtgcaacataatgatacacaaatagatagaggcatgagaactgaatcaaagaagtcagaactgaaggacagccagaaaatgggtgtgagctatctctt

SEQ ID NO: 88627 - DNA, 497 bp, Homo sapiens
ctcctgggctcgaggaatcctcccacttcagcctcttagttgagaccacagatatgtgccaccctgcccagctaatttttaaaaattatttggcagattcccctcaacttggggctgtctgcttttcctcatggttagattcagagtgtgcattcttggcaggaacacccaggagtgactttgtgtccttctcagtgcagcatatctgggagctcatgactcagcttgtttattattgatgacattaactttcatcacttagggtgctgtgtgtcaggtttttccactgcaaaattactgtttccccttgtcaatgaaaaggtattataatttacggggaggtactttgagactgtgtaaatgtctattcctcatcacaccttcacctgctagtttctgcatccggtgattttactctgatgcctatagatttttatttttgaattccatccttccttctgcatttattaattggcatagtactgcaaagaagggct

SEQ ID NO: 88628 - DNA, 870 bp, Homo sapiens
ttgattgtttcctcatgattagatgcaggctaaacactcttggcaggaacattatatgaaacattgtagtcaggtgctactaccaagaatatgacttattgttgaaattagagacacacttcaaaatagatcttttaaatacttgcaacttctcagtgataacaaaagaaaaagtagtaccaaaaaaggggcaaataacctaatttgggtttggattttctttttatttgtttcagggaagcagctggactaaagagcattagatttgaactcagaaggcccaggttcatgtcctaactctgctgccagccaactgtgatcatgggcttcaacttcatgtgtcacagcaattgagccacttaactaactatatgattttaagaatgtctatacataaaagtaatgttaaaattcagacatattaaaaatacaaaatgatattaaaattttatatatcaccgataaagggttggaaaggctatctgcattatctggcagttcaatgaaaggaaatcaatcataatagttatagattacagtaatacacaagcaatccattttatgtaacctcacttttaaacggaagataaaacatacaagcctaaattaacattttataacaaactcctatactgaaagtcagtctttgatgttatctggtggcaattaatataattgcaattatgttttattatccatactaacaggcatcccttgtaccatttaatgatttttattgacctaacatgtgactaatcctacagaagcaaataagtagcttattaaaacttttttaaacatcatttataaaatcatagcaaagtcttaataattcagaaaattttgcatttgtgcctggctcaaaatgcc

SEQ ID NO: 88629 - DNA, 226 bp, Homo sapiens
agagccaaacagaggagcggtaatctaattagcctgttgccatctgaggccgttggctaagatgggggctaactgggtgtggagcagttttgctgggtgaggtttagtttccaacgctgtaggaatctgctgcttccaaaaagtctcctttagaactatcccctagcagagaatgtccatcagcctgtagattgtctcatcaacacatcaaacatgctctacccaa

SEQ ID NO: 88630 - DNA, 451 bp, Homo sapiens
agaatggtgtaagaacacgtaagtaaatacaagttccatttttcagtaaggtggtcgtttctggaatattcattgtatgttttacagcatgaatatgttttacatagttatatacctaatatttaactatgttatataattatatatttacttggcacggtgactcattctgataatcctaacactttgggagactgaggcaggaggatcactttagcccaggagttcaagaccagcctggacaacatggcaaaatcacatctctacaaaaaatttaaaaattagccaagcatggtggtgcatgcctgtagtcccagctactcaggaggctgaggtaggaggctgagacaggaggatcacttgagcccaggagttcaaggctacagtgagctatgatcacaccactgcactccagcctgggagacagagcaagagctgcctcagaaaaaag

SEQ ID NO: 88631 - DNA, 288 bp, Homo sapiens
cggagtcgatgacagccacttcacaggctcacgcgctcctagtgtgggcttgaaggggacggggaccgattaccaaaggagagcgctgagtacggaagacacagggcagcctttgtcttgggtttagcgctgatgcgctcaaccctgagtcgggttcactgcaactgttgtgtccgatttcggttccctgcaaccgccctcctgggcgagagatgtcattgtgttcctgcggccagcgggactgagagctgggacttaagacgccaggagggtcctgcgctcacgggt

SEQ ID NO: 88632 - DNA, 320 bp, Homo sapiens
gtgcaattagtattactggtatttatgaactgctgctataattaatttagcacttatttgcctccaaagaaattattacctatttcacggataataaagatttataccacagctaagaacccatgtagttgtattaaaggttattcagcaaaagactttggtactactcataaatacaagtctaagaaaatctgacaatcgttggctgccaagtagaatttctataatttgctgaagaaggagtacgttgggaggtatcatcttggtaacttttttttttgagacggagtttcgctcttgttgcccatggcactatcttg

SEQ ID NO: 88633 - DNA, 450 bp, Homo sapiens
ggtggatttcagaacataaaaggaagagagagaactggagagggggaagatgttagcgaacacagccaagctaggaaacgggaaggcttgcctcccgcaggtattggccattgctgatcttggttttagtcacactaactggctgcctcataaaagcagcaaccaccttagtgctgggaaaaggtaagaggccacgaagaccactaaactcagagcagcgtccacccctgcaggccccctgtggcctacctggagggtctcctgaaaattaaactctgcattcacaccaacctgcccgctgcatctgggtgaaaagtgtgtcggaacatgcagcctcaagtctgctcttcttaataaactgtcaccatgagtaataattattccttgagaaatagcagagtgactcaaaaagctatcccctccccctctgccgcccccttgcacagctcg

SEQ ID NO: 88634 - DNA, 848 bp, Homo sapiens
accattatggtattatacagaggagtttcacttagaaaatgataaaattcggtttatatctcacactgtacacaagaataaactccaagtggatcagaaaaatgtaaagaaatgaaactacacaagttgtgagtacactcggcaatacaaaacaaaatgaagctacacaagtgctagtagaaaatatgggtaaattcccctataatctaggtctatggaaggcatttctagctatgactcaaaattcaggtgtaatattagattaaaatttgactgcatgaaacatttgtatgccagaaacactgtaagcaaatttgaaagacaaatacaaagtgggagaaaatatttgcaacatttatctcatataaaggacagtaaaagcccttgtatggaaagaactttcaaaagggggtaaaaggctgaaaatctggtagaaaaatgagcaaacgattgaggggggaaaaaacattaaaatggcctttaaactaggaagtttaagtttactcataagagaaataaagctacactgagatacaacttcttatatatcatattggcaaaaatttaaaaagctctggtaatactctcttggtgatgccctgaagaaactggcatactcaaattttataccaaatggtacaactctgttggcatatctaactatgttcactttatgacccagtaattcctcatttaggaatttattctggagatatacctccaaaaatgtgtaaatatttatgtagtgttactgtacttgcaaattattggaaataacctaaatgcttatgcaggcgagaataattgaataaattatggcccatttacactgaggtatactaagatgt

SEQ ID NO: 88635 - DNA, 594 bp, Homo sapiens
accattatggtattatacagaggagtttcacttagaaaatgataaaattcggtttatatctcacactgtacacaagaataaactccaagtggatcagaaaaatgtaaagaaatgaaactacacaagttgtgagtacactcggcaatacaaaacaaaatgaagctacacaagtgctagtagaaaatatgggtaaattcccctataatctaggtctatggaaggcatttctagctatgactcaaaattcaggtgtaatattagattaaaatttgactgcatgaaacatttgtatgccagaaacactgtaagcaaatttgaaagacaaatacaaagtgggagaaaatatttgcaacatttatctcatataaaggacagtaaaagcccttgtatggaaagaactttcaaaagggggtaaaaggctgaaaatctggtagaaaaatgagcaaacgattgaggggggaaaaaacattaaaatggcctttaaactaggaagtttaagtttactcataagagaaataaagctacactgagatgcaacatcttatattgcatatgtttgcaaattctttgggtcaaggccagggggatcctcta

SEQ ID NO: 88636 - DNA, 356 bp, Homo sapiens
ttgttagtgtccttatgatagttgcaaaccagaaaggagtcaggttttcttgagtgtggaaactcctagagggaaaactgaacgaagagtcgatgacaagccaatacacccatttttaatgctcaagaagtaaactagccaggcacaatggcatgtgcctataatcccagctacttggcaggctgagggaggaggttcccttgggtccaggtgtcccagccctggtcagaagccattcctcctctaaggtattcctgggtatctagagatactttaatatgaaatccaaaattgtattttagcataatgccgtttatccatcagttgccagcctggaacggggatggagcacccat

SEQ ID NO: 88637 - DNA, 1415 bp, Homo sapiens
ctgggaggtgagggacccagagaagatgtcctgtcctgcacttaaacctgcccttgaaaactgagtccagaaaagtagcaatggaaactttgtagtactttgctaacctaagtttctgtattttcttcgtatattttgtcatatagtattagtagatttcttttcggaagcattagtgcctcttttattgtgcagaagagaataaggagtggagactgtctctgtgttggaggttcagtgtcagtaggggagtcacttctgtgtctggggtgaggtaaggtagtagcagtaagcatcccatgagaggacctggaaggtgaggaaaaacttgggaagggcactagagcctgatttttttttttttttttttaaagcagtctcttctactaggactttcacctccttttacgagtagaatttgtattttgttatgctctgtgtattagtccattctcacactgctaataaatacatacctgagactgggtagtgtataaagaaaaagaggtttaatgggctcacagttacacatggctggggaggcctcacgatcatggtggacggtgaattaagagcaaagtcatgtcttaacatggcaccaggcaagaagagaatgagtgccagcaggggaaataccagacacttacgaaaccatcagatctcatgagaactcactcactatcacgaggacagtgtggggaaaaccgccctcatgattcagtcacctcccgccaggtccctcccacagcacatggggattattacatttcaagatgagatttgggtggggacacagagccaacgcttatcattctgtttcaaacatatgtcagctgaagaatacaaaattaaacaaatacagtatagacaagagtcaagcacagaagtaagtgctccagtggatgagaaaatgtgagagaacattagtggaaatttcatgtccagatgaggtgaggggtaacaagtaccatcaacttgatcatttctgatttttccaggaatgccaacttttgactaaatatttttttccttccacttcccatttacttatcttaattagagtggcagggacacaagaaagtagggatgagggactgaactgttggatattatttaacattatctgtgtggattattcttttccctcctcttcagatttctaagtattgtttctccatggtgtggtgacagcatatgtactgcctgaaatcgatttggcataagaagttgagtagaaaaccttactgttacattatttcagaatatagctcaatggttaaattaagagttagtatcagccaggttcagtggcttatgcctgtaatcccagcactttgggaggccaaagcgggaggattgcttaaggccaggagttccagaccaatgtgggcaatataatgagacccccatcttta

SEQ ID NO: 88638 - DNA, 383 bp, Homo sapiens
ctttggttcttttgaggtgcttttctctttagatagcacagatgttcagctactgttgaggtacctggcacccttccttccttgtaaggcaaggtgggcctcatcctacaggctttcacaagtgggttggagcaaactgaatcccaggaccaaagggtcccatccctgcagcagcacttactcctgccatgctaccagccaggtcccccactgcatctcacttcccttcctgcacttggctgggaaaagacccaggagcctgggctgactggccaggtaaaaaccaggtagaaagcaggggctcctgcctgtaatctcagcactgtgggaggccgaggctggaggattgctcggacccaggagttcgagaccagcctgggcaa

SEQ ID NO: 88639 - DNA, 204 bp, Homo sapiens
tgatttgttgcttcctaatctactccttcctcagtatggtattatctagaaacaacagcaccagcatcaggtttcgtcagaggtcatcactttgtaatggatgatttctatattttaggagggaaaaataagatactctgaaaaagagcctatcccaaagcaaagaccaaaactggtttgtgttggacgttgtgatactcaaac

SEQ ID NO: 88640 - DNA, 431 bp, Homo sapiens
gtagattcaaagagtgaatgaaatttgtttcctctgaaccatagtcctcagcaggtggaatggcagtggatggtgtgaggttcccacaatgcccaggtgtatcaccatctagccggggagctgcctttccttattctgcagctgctaggccatcagcactttgtggggactgcccaagccctaaggggaaatgtggtagtttcagcaggtggagttgattctccttttccaggtataatggatcggtggagatttagataagaaaaagtagcattcagcagtagaaaatgtactactcctggctctgctattgagtcatttagtcaaatcacttcatctctttgggtatcagttttctcatctgtaaaatgggcagttcaaccagattagtagtttttttttttttttaatattgaaagcatttattaagc

SEQ ID NO: 88641 - DNA, 573 bp, Homo sapiens
tgatctagaggatccctaacacgcaatctgaggatgtgcttaacaattactgtcagttaatttaattgcgttgtgggaaaggctgtgaaagagaaatttgggctgctttgaaagtatatcacacagggtgagagaagcggtgctaagagagaaattatctttgtataaacatctcggtagcctaggtggagtagccaaggtaaaaggacgtgttttaggcagaggcggcagcatgtgtgaaggcactgaggtgctaaacggtggacatgtcccggaagctgaaatagaccaattgtgcctggaatactgaggtgttacagtagattgactcaagataaggctgggcctagatcaaatcctgcattgtgtttctggccacctgaaggatttagtccttcctaagagcaatgggaagcctttgaagtgtttttagggaggacccgtaagatgatttatattttaaaaagaatgacttacctgctttgtggacagtgggtttgtaaagtatgaaattttctattgctctatagtttcagcagtcttattctcagttttataggtagaggtgcttaa

SEQ ID NO: 88642 - DNA, 435 bp, Homo sapiens
aagagcccatcaactcagaatatagaagcaggctgtgtgtgccagtattagcagttataatcaaatgagcacagggccaacagagcagtttcaatacagctggttcttagccctctaggtggactttgggagttgacaaggactccatgagaaccaccttgatgcaaggaaaacattttaaaactgattgattttgatctaaagatggtgctctgttatatctctggctgccttgttcccccaggaaagaacacattgagacaaccctcgcttgataaaaaatgactccacttgattgatcatcttcaaacaaaaaatgggccctttccacttaagatgcaatgaagccactaactggtttctgctaattaaaaatacagcatgtctagcacctaaacatttagcaaaaagttgaaatcttgattaggaaaagga

SEQ ID NO: 88643 - DNA, 1939 bp, Homo sapiens
tgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttccctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcgcaaatctgcctctacccaccacaagtctgtctttagccactccaaggctgcctctggtcacctcaagcctgtctctggccactccaagcctgcctctggtcaccccaagtctgccactgtctaccctaagcctgcctctgtccatttcaagggtgactctgtccatttcaagggtgactctgtccatttcaagcctgactctgttcatttcaagcctgcttccagcaaccccaagcccatcactggccaccatgtctctgctggcagccactccaagtctgccttcagtgctgccaccagccaccctaaacccatcaagccagctaccagccatgctgagcccaccactgctgactatcccaagcctgccactaccagccaccctaagcccgctgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttgttgatgttgaagatgatcctgatgaaatggctgtgtgaaaaatgctctcgtaggtggccaggcagt

SEQ ID NO: 88644 - DNA, 770 bp, Homo sapiens
gagatttaaattagttataaagcatgtgtacatatgtgcctatttacacatgcgtgagaaaaaaccagcaggaaatatactgaaatatgactagtggttgggtggtaagcttcttaatttttttttaatactttcctattatcttcttactgtagcatggattacttcccaaatcaagggggaaggtagatgctatctttaagacagtcattccctgtcttttcagtcctctgctgccaccatacctaactccccccaactccccttcacttggtaccatgttgagctgagctctaggtatcttccaggcatgggcctttaaaaagatccttttccttgtacctcttgtactttcatggtaatcggggccatctgtgaccttgaaaggacaggtttctcccctggttattatgaaattcaggaagggtaattgatgccagggactacccacctgccctgggcccccctcggcctgactgctgactccacgctcagttccatccctagaggctgcccagcaagccccttcccaggattgagagaaaggacaccgaaactcacagaaattaccttaccctgtatgacctggttaaaaagaggtttcctactggctggcataaatgttccagctctgcaaactgataggttttatggtgatagaaaaggagccttttaaaataattaaaaataaaagtctcattcggttttgttactctacaatttttaggccaaaggaaaaacacaaaaaggagaaaaaagaaaaatcaacc

SEQ ID NO: 88645 - DNA, 335 bp, Homo sapiens
ctactgtgtcaccagacagtccttgactatgttccagtaaaaagagaagatgatacctaaagcgttctgatgggtataagtgacaagtgtgattggaggcaggaggaagatttgtcattctaaccctctatgatttaagctcacattggatgaaatttttatttcctggttccatcccacgtaggaagttgtgggcggcagtgaggattaacccaaatggagaagacatttgagttctccatgaataattcatgcaggacataatctgaacacagataccagagccctggctgcagcatagctttaacttttgtacatttgctctccctaagggg

SEQ ID NO: 88646 - DNA, 338 bp, Homo sapiens
agaacttagttaagcacccaaggtaatttatgtatttcttctgtttacagtaactttaacttagatttctggtaaacatggcaattgtcataaggaaatatatgttatttgctatgttcaaatttaaactctcagaaactgttcttgaagaatctttggtttagtatttcatttccattcatagtccaaacatttgttgtatgtttctgtgtggtttatatattttttctcgtcattgccacaagacctttatttagaattttaagctaaatatttttttctttgaataattcatcttttaaagtcccttcctttcttttgtagagtctctatgatca

SEQ ID NO: 88647 - DNA, 2838 bp, Homo sapiens
aagccccaccaaaacccatttaagtatttaatgtacatactattcatattattatggcctgtaaacactaatatctgagcaatcaaactgttttatctaccatttttgatgaaatttgaataaagtttaaaaacgtgtaagcctttgaacaaatgtatgaaagctttaaaagatcattagcacttttattttgtttacaaataagctgccatttaaaaaaataaaacctcactacttgaacataaagctcccaaacaatattgtattaaaatgtactatattgacctaggaggatatagaaattatattcacctgattaactggagcagtttcacatagtagaaatactttttgctaatttgattataagtgctcaaatttattgaaattagattctcatgcctataaaagtatactttaaaaatattttgcaacaactgtcaaattatttgggttcctttaaatagcaaacaattgggaaattttccataaaaatgaataggttttattaatacctgttcatgtagtatgtggactaaaacaattgatatatatctgtatgtaaaaatgaatgatcttatcttgccccaaatttttcttacctgattctgagccagcctttttgttttgatggcaccctgtgagtatgttccattttctgtgaactttgtcaaattcatactatatgaggaaatgatctaatattgtgggctccaggcaggtcatcttaattgcatgtctgtctcttctgtaaaatgatgaggtggaacctagagctggacaaaaaattagagatcacttaacattctgtgattcaaggaattcttaggacatttttactctatagaatctcagaatgattattctcagatctactgtccttggtggaaactctcacagtgccttgcatgcagtaaaagtttgatttgccgactggctgacgtgttaattatcacacagactccaagaacctgatgcttgctagaccttagttccttggtgatgctaagagtaaatgtagttttcctaggaactgagcactgaggtctgtgtcctttgcctgtgtagaatctgtctatgcagttggtattcaggcaagaattttagctgtaacaacaatggaaatattggaggacccactttggcatttatgtaaagatttcatatcctatccaacatttactttagtgtctaatcaaattccataccctcaaaaagatctgttggaacaaattgataaaattaggtggaaaggaaagtggtatgggactcaaatacaagtcacttctggtttaattattggctctgctgcttaattcctctgtacctcacgtcctcattgtcgaagtggggacaataatctggacctacctcacaggggaattgaggatattttcatatattagtgtgctttgaagttgactgaaagatatactggatatcataattatataatttctaaatagatttctttaaatccatgctatgttttctttttcagtcaggtcctacagaatgactattgcacttggtctattgttttaatagtaaattttgttattaatctcctatgtgttaaacgtgggtaattgtattatgttaatacatacttagggaggaaaagcaggtggatgtaaatcagtgattcccaacttcagcagatgatagcagtggagggtatccttgagctttttgtaatatttcaaaaagtatattagaaattatacatttacccataatattcctgcttcacaagtcaattaagacattgaatttccattcattttgcctatattctctcaaaagctgtgaatggcagtatgtttttgattaataataaaataagaaatcctattatgtgcaacttattaaatacttgggaacatgggaaaagaataatgaagggattcttatggtgaaaatgttgggaaccacttttataaaggaactaagattatttgaccccctccacagattgcttacctagtctctaaataatgaaatgtgtgtgtttgtgtgttttggctatattaggctatataacttcaggttagaatttgccttcagttttttttctgttttagaatatcactggcctaatttatttaggtgtgtacatgttgctcatacatacacacacatataggattacaaatgtggaaaatgttataatgtcatattctagcattggactaaatatcaatttctgactcttaaagtagttctgtgtataaattcaacatgatgaatcaaggcaataatttctcaaatgttcttttatttctttgtttttatctcgactttttattttccattttttctagtacgcaaatagtgtaaaattgttttaatgcctggactttgaaacaagtaacaagtgtttgaaagtatataatctacgagcgaatttgccctccttggactaaccacatacaaatatgaatctggctgcaagaacaggatatccaggtaactagagagtgggcattgataaaaatatctggtggagaagcctaggatttcaactttttgtcagaggattcctgttgggacagctttaccagaaaagaataatagcggatatgttcatccaaactaagaactttcatgcatcttgcattgttacatagcctgtggaatgaattcattttttctcccttgagtccaggaatgacttccctggaaaaactcaatctatatacagctgtgccaaaatgaaggatacctgcctctccgaaactttcactgctgcttctgtcattgttcacttgtcagataaaattttattatctcaggatgcaaatttaaaataaagtgtaaatctatgttaatgaattg

SEQ ID NO: 88648 - DNA, 603 bp, Homo sapiens
ccgtgctctgcttcttgtcttggattaccatggatcctgtgggccatggttgtacacatttccatacacacccacactcaagaagggcacattcttttcctgcccctcttcagggcttgtcctttgtaggtgtatgaataatggcccctcatagagtggtgagggggaccctccgttgagaagcttaagcttctcaacgccattacactcttctggcccctaaaaatactcattttaattaataattgccagaggaaagaagaaatatttgagtaagacatgtagtttccctttagagtcattttttaatccagcaaattgcaaagccaggccaggcacggtggctgacacctgtaatccccgcacgttgagaagcttaagcttctcaacggctaacagctgttttcatcttttaactaatcaactgtcctgtgtgtagtgcccagttacctattggcttcctgacctttctttccccttgtttattgcatagataataaccatttggttgtggataaatattcatcaccaatttaagttactgagaaaaggggctgcacagtggctcacgcctgtaatcccacacgttgagaagcttaggga

SEQ ID NO: 88649 - DNA, 732 bp, Homo sapiens
tgtgccccaggagcgtcatcctgcacagacacctggggttcatattaaaatggaacaatgaggaatggtcaggcttttaagcaacctcatctttctgctcgtttcagtctgggagtggggggacctttcatacaagttgtcccataatcgtgataaaaatgtgtgtgagatatccactttgaagacaggggcgagggaagttcactttcctgaacatacaaataatttggcccatccacaccaaccgtctagtggatatcttctcaacgccattacactcttctggcccctaaaaatactcattttaattaataattgccagaggaaagaagaaatatttgagtaagacatgtagtttccctttagagtcattttttaatccagcaaattgcaaagccaggccaggcacggtggctgacacctgtaatccccgcacgttgagaagcttgcttctcaacgtcttgtagcaaggttagcaatcaccatgtgtaggggaagagccatagtgttcctagggtgggtagagatgccacaagagggcgttctgagtgttcatcttctctaccttgaaaaatgttccatttgttctctggctgcattccaaagcgatacgaagacttaaggtttttagttgacctaatctgattgaatacatcttttaattatgaattcatgtgtgttgactagtttatcagtcatgtggatgcaagaccgcgcacctggtctgcaggc

SEQ ID NO: 88650 - DNA, 673 bp, Homo sapiens
tgtgccccaggagcgtcatcctgcacagacacctggggttcatattaaaatggaacaatgaggaatggtcaggcttttaagcaacctcatctttctgctcgtttcagtctgggagtggggggacctttcatacaagttgtcccataatcgtgataaaaatgtgtgtgagatatccactttgaagacaggggcgagggaagttcactttcctgaacatacaaataatttggcccatccacaccaaccgtctagtggatatcttctcaacgccattacactcttctggcccctaaaaatactcattttaattaataattgccagaggaaagaagaaatatttgagtaagacatgtagtttccctttagagtcattttttaatccagcaaattgcaaagccaggccaggcacggtggctgacacctgtaatccccgcacgttgagaagcttaagcttctcaacggctaacagctgttttcatcttttaactaatcaactgtcctgtgtgtagtgcccagttacctattggcttcctgacctttctttccccttgtttattgcatagataataaccatttggttgtggataaatattcatcaccaatttaagttactgagaaaaggggctgcacagtggctcacgcctgtaatcccacacgttgagaagcttaggga

SEQ ID NO: 88651 - DNA, 549 bp, Homo sapiens
catcccagacctgggctgattacctccagtctttttatttgtttgaaagagaaataaatgatagtatttaatcagtttattttcagttactccatctagacccatttttagggtctagggttactctgacagatacataaaagtgtttttctttttgatcacttgtaaaacaattttctgtgtaaataaattcctcaggataataaagtttgacggtatgttctcaggtccacaacagcattgaaagactgttttccagtaagatttcatgtgttggacttcagtgattagagaatttggttgggtaagaacgggtgaatgagcctggctcctgaaaaaagagaaaacccatgctggattcatcaagaccttacattcagcaactattgtctgtcacctcaacagatgaaacaaccaacaggtatagtgggagccaagagagaatacatacgttttgacattaaaatgttttgatattaaacatgaggctaaattttgcaaaaggtacaggttagagcataaaagagagaagcatggtagtggtgatgt

SEQ ID NO: 88652 - DNA, 421 bp, Homo sapiens
tgtgtttgtgttctccaggcgcctccttctccactctttctccagtgctggagacctaggggtgtgcatcctggaggattgtgaggaacctcagctgctcccctcgtcctctgaccaggcggtgggctcagggagctttggagtctcatgcggtcagcagcgcttagcatgttcagttggctttttccatatcaccagtgacatctttcttcttcctaatcatcgactcatggaatattagaattaccaagcctcttgcagttcctgtggtctaattccttcattttagagatgaggacccctaaggcctggggaggggagatgataggtgtagggaaaaaaaaaagaaactttttcctctaaataagattagcaaaacgataaattaacaggagaaaaatagagagtttattaacacgtg

SEQ ID NO: 88653 - DNA, 696 bp, Homo sapiens
tgatgggtagaaacgaagtaagtttcctttatttctgggattacaaaaattactttcctacgacagtaactacttttagtcactggaaagcttctttctctgaagattatcataagtctctcaggaataaacacatattgtccagagcttggagaggatccttaaaaacattttttatttcattttttagagacaggatctctttctgtcacccaggctggagtgtggtggcatgattaggattcactgcatgctccaccttctgggctcaagcaatcctcccatctcagcctcccaagtagctgggactataggcttgtaccgtcactctgggctaatttttttttttttttttttttttggtagagatgaggtctcaaaatatggccccatctcaaactctgggctcaagcagtcctccagcctcagcctcccaaaatggtgagatttaaagacctattgaatttaatttaacaaagaaagtttgcttctatccatatctagatatataatgcaaaatttatctgcaacctttcaatctgataaagaaatgacactttatgaaagaacatttagcattgtttagatcaaagtcagtgaataagtctttttcctgacacaaaagaggctttggttctttataaatttacaatgactcattaaacatcaatttgacattaaaacaaagtaagtaaa

SEQ ID NO: 88654 - DNA, 179 bp, Homo sapiens
caggatggtgggtttgaccctgtaggaacagggtccttcactcaggggccacactctgcagtccaacgaatctgtacccttggtcccaagctccagcaaagggtgagcaactcagctcaagccaccagctgggacaaatggctctggtctgtggctctgactgggggccgctggcattc

SEQ ID NO: 88655 - DNA, 639 bp, Homo sapiens
cagctgatgaatactgagtgggattcaaatccaccattccggctccaggtgctcattcaccacactgttctgggtgctataacacccattctggctttactccagcaatttgctgagggtctgcctgaggtagcaacggaagagatggaaaagagaggtcgaactgaaagcccactggtgagacttggcaattgattcaatgagagaaggtggactgcagaccaatggcccgctttctggtttaggtggcagagtggctgatgatgccacatttgaaggtaggatacaggagaaagactggggccttgggggtgcacgagggtaagttcagtttggacctgttgagtttgtggggcgggatgccaccgaggtgcatatacaatggaagaagcttgctgcaaatcaagatttagaaggtattcctacaacctccaaactgaacgaagacagttctgtctttggatttcaagtgaataaggatcagtgaatcgggctatcctactgcataaatgagtctactctgtaagtgagtctattctcagaacagtttccgtaactctagggccctctccttcatgcttaaaagcactaatctttcagaaatgctgtagtggtgttctgtgcctggacgtaactgac

SEQ ID NO: 88656 - DNA, 417 bp, Homo sapiens
ataacaactggtcactggagagaaacagagacttgggggcttttccagacacacagctagtaagtaatagatccacatttaaattcagttttctcttactcgaaaatccatgttcttcccacttaatcagatagggaatgattgccacgtgttcctcttgccacagaatgacaccaggaggttccatctctaacccatgtttcttttcccaagcatccctcagatctatgacccaggccaaacccaagccaaaaatgatcacccctgattctaggccaaaaaataagaatcgtgtgaaatctaagcagaatgaggctgtgtcaccactagccaaacctcttgttcatactgcgcaggttttaggaaaacaacagcctttaatgcatgctcgaaattccttccatggtaagccactgt

SEQ ID NO: 88657 - DNA, 423 bp, Homo sapiens
tttgacttgaatatagagtgtctgataagcctgtaagtagtatcacaagcagtatttctaggctttcattgtaaagtttagggttgaaatctgggtgttgaaatttcaaagttccaccctttgatgatatagactaattattctttattatatttacagtatgcaggcatgacacaggtttcaaaagcactttcccattcttctttaataatcacaattatgatcataacagttaacatgcactgagatcctacgatgtgccagtccgtattctaagtaccttgcatagatcatctcatttaatcctcacaacccacctatgaggtaaatgctataattatccccactctactgaggaggaattaaagtacagacaggttaatgtgctccgagtcacacagctattggaagagataggattta

SEQ ID NO: 88658 - DNA, 689 bp, Homo sapiens
gtcggccggggccgccgggcaggagggaaaggttatgggtcggcccggcggtctctcccagcacccgcgactctcaccttgctcagctgctggtggatgagctgcttcagctcggaggctttctccggaggcagcgacatgctggcagccggcgtctccccgccgcttctccccgcctcagatgccctaactgcgcggccccggccgggccaggagcgttaggagcgactggagcacaaagcgccgcagccgttcgcctagcgcagctcccgggggacgcaacgccgcgtcaggccgggggctgacctggaaatgaggccccggcggcggcggcgccaactgttttcaaacagtggcggacaaacagggcttggggctggcccgcacgctgcctgatcgtttccgcccgccgctccacctccccgcgggccccgcaccccgagacctcagcggcaccccatcgccttgcttgccagggtctccgaaagcgctgctggcccctcttcgcggccacccggcggcctctttccgccctctgaaccggcagcttagctggacgggcctcaagggcccggcgcccagggactcaaaggaccctcccgcgccccgcgaggctccggggtctcgggcttccgccttcttgctgccctcgttcttgccagggccgcggttagtccctgctggccacc

SEQ ID NO: 88659 - DNA, 327 bp, Homo sapiens
tccaaaggagagaatcaattttaagaaataatttaaagacagaaagaaggtcgggcgcgggggctcacacctgtaatcccagcactttgggaggccaaggcgagtggatcaccagaggtcaggagttcgagaccagcctggccaacacggtgaaaccccatctctattaaaactacaaaaattagccaggcgtggtggcaggtacctgtaatccaagctacgtgggaagctgaggcaggagaattgtttgaatccgggaggcagaggttgcggtgagctgagatcacgtcactgcactccagcctgggcgacagagcgagattccat

SEQ ID NO: 88660 - DNA, 391 bp, Homo sapiens
attcctgctctaccagcccagaatcttaccaaagtcatcattccaaaccattcctgtatttctctaaaacattcttggaatatttcatcttgtctgctttccctctgtcagtcctaaaaagtacagatgtccttcaagtgtagctttacttgagattctaccaagttgaggttatttccattaacttggtcttccatatacctgatcctgtgtgcctaaccacttgagggaggttgcacactgagatatgtgccacccaaacgggctggtagggggaagtaagttaggggaacattgaaacagaacgggtcaagcggagaatgcagccacaatctaagaaacccacagtatattatcaataagtatttgttggctggctggcagaagctaa

SEQ ID NO: 88661 - DNA, 222 bp, Homo sapiens
ggtcattgtccctgctcttaccctatgtaccctgtccctttctcctccttcaggtctaggctcagagctctctcccatgccctcccacccctggtctcaagctcctgagctcaagtgatctacccacctcggcctcctagagtgctgggatgacaggcatgagccactgcaaccagcctctgcatggggtttcctcaactttaggtctgtgccctgaagggg

SEQ ID NO: 88662 - DNA, 492 bp, Homo sapiens
cccatgagatgatagctgtggaaggtaggtatggttatacaaaatttcattacacttttcccctctacttttcctaatatattctgaattttcataaccaaaaagttaaatacacttaaaagtagacaaatactaatttgaggtggtggttaaggactcagaagttacagtccatgtgtctgaatgaaagtactttctcaaacatgcagatatcagagatttgtaggattccttcaatggagacccatgttttctccacacagaacactggtttctgagcaaaagtaggccctctttctgaaaacagatctgacaatatgaaagtggttggctacttaactgaagataccaaaaggaaaaaaaaaaggacaccaaaaaactgggtctacaaatgtggttgttggttctccttgttttttttttcaaataaggctcggtttaggagcagtctaatagagcatgtgactgctatacttccaacagtatctttgc

SEQ ID NO: 88663 - DNA, 260 bp, Homo sapiens
caccatagaatactactacacatagagcaaaatagcaaaaatgaaaaagatacacaatatcaagtgatagcaaggatgtggagtaactcagactttcataccctaagggtaaatagggtaaattggaaagctggctgcatctacaagagctgatttgccagcaattacatttctaagaatatgcccagcaggtaatcatatatatgttcaccaaaagatgtttatgagaatgtttatagcagtgttgttcacagaagcta

SEQ ID NO: 88664 - DNA, 100 bp, Homo sapiens
tcacgtggaggaggtgggctcagaagaatcgatggccacggagaccatgttcatgcgtgggccaggaggaatctggagaggctggagccttagactcact

SEQ ID NO: 88665 - DNA, 215 bp, Homo sapiens
gaagatgtgataagtgtgctgagaccacacaaagaaactgactccatcagcagagggtgatggggtgagcagaggctttccaggcagagggaattgcatgcggtgtgcatatctcttctctgaaccttcatttcctggcctctacatggagaaaacaaggcacacctctctgggtgcccagaagcacttacatatattgtctggtagtcatgggc

SEQ ID NO: 88666 - DNA, 545 bp, Homo sapiens
cacccagtctatggtattttgttatggtagctcaaggagactaagacaaacatgaatgcaaatatcctcaacaaattattaccaatgttaaatccaacaatgtataaaaagaattgtacagtaccctaagaaggggagagtgtaacttttcagtgtttaagtgtaggcttcacatagtgatttccttccaaagagtacagtatgaaaaggaggaagaaatgggttatctttaaaatggagaaaactcacaaaccctactttagccaggtggtcaaggtcaacatcaaaaatcataaaatcatgttcatagtatgtactcttgatacagtgtgatagaaatcgcacttcatctgtgatcttctttccctaaacccataccccaagtctgattatgagaaaaacaagagacaaattctaaatgaggagcatcctataatacatttgagcagtgcttctcacaactggcaatgtcattaaaaacgcggaaagtatgagaaaatgtcacagccaagagtaccctaaggagatatgacaactaaatgtaa

SEQ ID NO: 88667 - DNA, 417 bp, Homo sapiens
ctccccccacctttcctgtttccctcatggttagctaatacctgatgttccttcttagcctttggtaaaattgtgaatttgacaaaggtagagttagtctccttttccagcacatctcaaccctcgcctagctctgccccaatagctctcatccagcacccccagctggtcatggccagcttccaccacatcgcctccagaggtgtagcagatattgatttaagtggctccattagggctgttcagagtaggcgaaatgaacagggctaggcctcctgagatcttggttcttaaccagtttgttgattgcctgtctttgactgagttaatgcactgctcttggactccaaatccagtatctgtggggtgtttttgtgtagatcagattataatgtaagtacagacacttttgggaaa

SEQ ID NO: 88668 - DNA, 614 bp, Homo sapiens
acacacacagatgaacgaacacccacccacacagacacacacacacagatgaacaccgacccacacaaacacacacacgcacgtggacacacacatatgcagacgtgcactcacatccatacacagacacatgcacacacgtcacaaagacacgtctgcacacgtgcgttttatatgtatgtaaatcagaacaagaccatggagacagagaaagagaaaagcgctgaagactgtatggggctttgacaccatactgacagcgttttctaacagagacacggcatgtcaggctcagccacgctaataaaacccttctcctcacgtggctctgggaaccgatgtgggctgtgggctgctgccctggacgcccgtcactccaccacggcaggtgaagctgccattttaaaacgatgacaagaaaacctgcgctgctcagcatcccattttgggtcacaggaatgaccccaatctggcctagaccaaaggagaaggaaccgcttgatgacaaaagcaaacactgcgtctttaaacggcgcgccctgcggctaaatgctgaagggtcacagccacacgaaggaaatgggagggagggcgacaactgcctttgattttta

SEQ ID NO: 88669 - DNA, 923 bp, Homo sapiens
gcctttatcttttagtttttaagatcatttctctccctcctttccccccagttttctcaacatttatgagttagttctgctgagaacaacatacttcagaacatgtcaggatagggcagttttttcttgtttttcttttttctttttttgagacagtcttgctctgttgcccaggctgaggcaggagaatcgcttgaacctgggaggcagaggttgcagtgagccgagatcgcaccactgaattccagcctgggcgacagagtgagtctgttttttttttgtttttttttaaagtcaacacaaatattgaaaataagcaacttcagtgcacaaataagctcaaaatcactagtgagtgatctattttttgccaataagaagtaccatttgtacatgacttaaagtgccttccaccaagaaaattattgaaaactgttgggtcacataacattcctacactttggatacagagtatttagttttatacaaaattaagacaacaagaaacctaggatgtccaaacattcatttcatttattttactgcatttatttatgcagtgaaaattgaaagatacaccaaattaaagataaaaccctgtgacagataacagtatatgtaataacatgaatatttatttacacttggtagagaaagcaaagctagctagctctaaactagaatgaaagtcgttttgaaatgggtacgggggtatataaggggaatgattgagtcacatgtaaaagcctttgtatgcccagtgctagtgttttcctgaaatctagtgagaatcacaaggtaccagaaataatcaaataataaatattaatacactgctgggatagaagtatctcagtgtaccagcattcactaagctataaaatctgtgacagcaggaatattaaattatgaacaacctggtt

SEQ ID NO: 88670 - DNA, 328 bp, Homo sapiens
aaaaaggagcaagtcggacacagaaaggtacggagggaaggccacgagaaacccagggttaccacaagccaaggggctacccgaacctgggagaggagcgaggcctggaacagatccttccctggcgcctgcagagggagcatggccctgccggcaccttgctctcagacttctgacctctggcaccgagacaataaacttctgttgttgaaagttagtggcactttgttacgacagccctagggagctactaccggcggtcagggcacggtgccagcttcttcaaaggccttcatgcaatgtggtctcccagctctgacaccaccct

SEQ ID NO: 88671 - DNA, 469 bp, Homo sapiens
aaatcatttttgagtcttccttcttatttaccctccaaggttaattcagcaacctgacaccatctgttaaacactactgttgatcccattctccaagatctatctttaatttgttcacttctctccaactccactgccatcaccctatcctaactatcctcatctcatgcctgacatcacctccctaacaaggcaacccaattctcttttcacttcactccaaacagcaaccagacgtgctcttttaaaaacataaatccaatcatttgaccttgctttaaagcttcaaagatttcctcttgtacttggaccaagttcaaaatccttaccaggagctaatgtccagcaagatcagattctctttccttcctccaaactcatcttaagacatactcctccatcacctaccaagcatcagtcattctaggcttcctcaaagtaagccttttcttgcctcaagccttttttt

SEQ ID NO: 88672 - DNA, 560 bp, Homo sapiens
agccatattcttgctcacttcttccacgatcccttcctgcttccctcgcacttctcttgagaacccttcctcaacagatcacactctccaattcccatctcagactctgcctctagggaatgtaacctaaggctcagggtcaacattcactggggatacccaactggccttgcagaaatggaagatggaagattgcttaatggcgttatatgagttatggaagggatgtctgacctgctttctctttaaccatcgtgaggaaggaagacgatgaggctctcatgcttctgtcttagggctttttgggtttgtagcttggtctgacatcttggttgtgtgtctctgggcaaggacaatttttgtccctcagtttccctgtctataaatggagataataatcatgctttatttataggactgttaagaggattaactgagataattaatatcaagaacttagaaggatatatggtacttggtgagtactatattacattgctgttattattactgatattattactattagtatcattgtcatgttaaaatgcagctacaga

SEQ ID NO: 88673 - DNA, 466 bp, Homo sapiens
gaaggacaaatcacacaccgggctctgaagtcaggaatgtttgttcgcttattccaagagcaaagtgctttatttagatttaagtagaagaaatgttttcttcacagaaaggaaaagtcatattggcattgcatgtttgctttaaaagatttttattaatttgttcattcaacaaatatttattgggaactaactgtgagctctgagcccagaatctcacacttacagaagtgaggaaatgatttgtctgatataagcctcaagcctaagaaatttctagaattatcaaatcccggtttaggtggcacctattgattaagtgtgatttttcagcccagttccaatcgatatttagaaacacaagcagagtgaggagggtagtagagttgtagattataaatcatagaattaaagaaccttagaaataaagtagctcatttcctgtactttaaaagcaagagagtca

SEQ ID NO: 88674 - DNA, 396 bp, Homo sapiens
accagagaaccggacatctaaagatctagggaaacacattccataagagggaggagtaagtgccaaggtcctgagtcaagctgagcttggcaagttcaaaaaccagaaataaagctggtgtggctggaatgcagaagggaaagagggaggcggcaggtctgatcccacagggcctggagggcatgaccaggaacttcagtgccatcccaactgcaatgggaaggtggaagcagggaggtggcaatgtcaggttcttgcctttaaaaagttcctcttagctgggcttggtggttcatgcctgtaattccagcacttgtgaggctgaggcaggagaatcacttgaggccaggagttcaagaccagcctgggcaacaaagcaagatgcccatcttaaaa

SEQ ID NO: 88675 - DNA, 514 bp, Homo sapiens
ggctgaagtgggaggatcgcttgagcctgggaggtcaaggctgcagtgggcagtgatcacaccactgcaattcagcctgggtgacagagtgagaccctgtctcaaaaaaacaaacaaacaaaaaaggatattgggattttattaatatcatcttaatgtgtttgttattttagtgtaccacaaaactatttgtgaaatttgtagtaaagtacatcttcccttagaaatgaaattttacttcaaggaggaatacttggctttcagtagggaacatattttattttaaagtaggtttatatatatatatatattatatatatctatgtagttatatatagtttatatatagttatatatagctagtattttgttcatacattaagctattgaaggtaactttatgtataagtatagctttgttacaagtttactttaatttcctgtctcatgatctaggtttttaaattttattttttttaactataacaagattacaataaaaagatcaactttc

SEQ ID NO: 88676 - DNA, 512 bp, Homo sapiens
cagaatgatgtcattttggaatgttcagtaacatatttctttttctacttgaaagtgaaacctgggaaatctgtaatttacaatctaagtttcccttattacgattcaatttcattccatttttctgcataaactaaggactctacaggcagcttttgatggctcagggttgtacatagtttttatcagtaggaaagtactatttatagataaaaattatcatagatcagaaataggtagtacatgctatgaaaacataaattggttcatcctggatgtcatattaccaaagttgaatatggctcatcatcatgaatattctatttcttgtgccttgcttacattcctatctatatgtctctggtttagtgactgtgacgattggggcttttggtttggtaagttttcccaaaagcattggtattcctaataccttttttaaaaagtctgtctctttttaaaatttgcttttctaagtttactacaaaggtttactttgctccttgaggaaa

SEQ ID NO: 88677 - DNA, 1312 bp, Homo sapiens
agcatagttactgttttctgtacggctaagtactgcctaatggatgaaagaagtttggtgcttcaattatttatgagctcagaactcaattcattaaagttattttgccaagtcatgccaagatatattgaaatttccactcatattggtttttaaaattttttttagtcctaaaattaataagtatggaaaatcactaaaagcagtgtaggataaggtgtgtttaactggccgggcacggtggctcatgcctgtaatcctagcactttgggaggccgaggcgggcggatcacttaaggccaggtgttcgagaccatcctggccaacatggtgaaaccccgtctctagtaaaaatacaaaaaatagctgggcatgatggtgggtgcctgtaatcccaggtactcgggaggctgaggcaggagaatcgcttgaacccgggaggtggaggttgcagtggccgagatcgcaccactgcactccagcctgggtgacagagcgagactccatcaaaaaaaaaaaaaaaaaaaaaaaagatgtgtttaactgggaagggtgataataatagaataataggtacaggaggaccaaactttagattataaaccagaaagttttgttattttatataagtgtatcagtattactatttatcatttatatagcattttatatttgcaaagtgtttaataatttttgttattctttacatatatatgaaataggacagttatcccacatgaacggtaaataaattgaggcacagaacagtaaaaaaacctcagggtcaggcgtggtggctcacacctgtaatcccagcactttgggaggccaaggcgggtggatcactttaggtcaagagttggagaccagcctggggcaatatagtgaaaccccttctctactaaaaatacaaaaattagccaggcatggtggtgggcacctgtaatcccagctactctgggggctgagacaggagaattgcttgaactcaggaggcggaggttgcagtgagccaagatcacgctactgcactccaggctgggtgacagagcgagactccacctcaaaaaaaaaaaaaaaaaaaaaaaaaagaacctaagacaacccagtgaaatggtagcaaaaaataggaaatataatgatcacattttctgaatcctagaccatcagcctaattcactgaggtgtgttgtgtatcactctattttatagatgattttatataagtaacagtggattgttttaaagctgacgtcattgtatgtggatacattctatatggaataaatgttatgtaaaggatgtgacttta

SEQ ID NO: 88678 - DNA, 491 bp, Homo sapiens
tgtttcatggtacttaattgagactttttcaagattcccctgatggcacatttgcagttgcttcaagactggatgatgtgcattgagttctctgttctcccaacatggctgttcctaaatcaggattctggtttttttgagatggactctcgctctgttgtccaagctggagtgcagtggcgtgatctcgctcaccacaacctctgcctcccgggttcaagcgattctcctgcctcagcctcctgagtagccgggactacaggcatgtgccaccatgcctggctaatttttgtatttttagtagagacagggtttcgctatgttggccaggctggtctcgaactcctgacctcgtgatctgcccgcctcagcctcccaaagtgctgggattacaggcgtgagccagcacgcccggcctaaatcaggattcttaacaattaaagtgtatctgaatgaggaaggaaacgcttgtcattctctagtcttaccca

SEQ ID NO: 88679 - DNA, 442 bp, Homo sapiens
tgtttcatggtacttaattgagactttttcaagattcccctgatggcacatttgcagttgcttcaagactggatgatgtgcattgagttctctgttctcccaacatggctgttcctaaatcaggattctggtttttttgagatggactctcggctactgcactccaggctgggtgacagagcgagactccacctcaaaaaaaaaaaaaaaaaaaaaaaaaagaacctaagacaacccagtgaaatggtagcaaaaaataggaaatataatgatcacattttctgaatcctagaccatcagcctaattcactgaggtgtgttgtgtatcactctattttatagatgattttatataagtaacagtggattgttttaaagctgacgtcattgtatgtggatacattctatatggaataaatgttatgtaaaggatgtgacttta

SEQ ID NO: 88680 - DNA, 343 bp, Homo sapiens
gaatggtttataaacaaggcagtgccttgatctgatttgtgttataaaaatttcagtctggctgcaatgtggataatagtttggaatggggaagagaagatgttgggaagctaactctcctagcaagaatgatagaatagcttacagtagggtagtggcagtagtggaggagatggaataatggagattcaggggcttgaatttgttaaccatttagttcaacaatatttattgattggcttctctgttgtgagcatatctgggagaggaagaaaaacaagccaggataatccccaggtttctggtgtataaatgttggtactactctgcgatggaatggaaa

SEQ ID NO: 88681 - DNA, 410 bp, Homo sapiens
agttgagaacatggctctgtctcagataactgcctagatagggctcaccactttggatatttctttatctattaatataaaaggccagagttaacttaggtgatctcaatggatttttttaaaagaagaatgattctgttatctacgtcagaaggatagacaggaattttagcatactgttcaaaatttttctcacgaaggtttaaatacttgttagaaagttataaagaaggctgggtgcagtggctcacgcctgtaatcccaatcccagccctttgggaggctgaggcgggtggatcacctgaggtcaggagttcaagaccagcctggccaacatggtctctactaaaaatacaaaaattagccgggtgtggtggtgggcacctgtaatcccagctactgaggcagga

SEQ ID NO: 88682 - DNA, 251 bp, Homo sapiens
caacatgtacacacagacattaaaaactcatttattttcccactcaagggcacttaatagctaaggttccaggagcacatgccccaaagggctggaccatgaagttagggctatgctaagctccaggtatgctctaaaacatattgggaattgtgcctggcctcccctgccttctcacggttctgacacagcatctcacctgcccagaacttgtgacagtcacttggcttcattttggacgaggctctttt

SEQ ID NO: 88683 - DNA, 594 bp, Homo sapiens
tcataccagtctggttctaccatattcacatttacccaattaattttatttgaaacatctatttatatatgtacaccaaagaaattaaaccctgccattttccctttgtgcttaagaaaccagagccactgttagggtactcacatgtcaaagatattcttaataggcttcaaagttgggtgtatataaatgtgacagaactgaaggggttactttaagagaggtattaaaactacttgaaattaattcaaagggatctttttatttctgtatttaaaaattagatgagagcaagattaccacttcaaaaaaaataacgtaactctcagtcttaattttgtgaaaaacttactttgctatcttgatgagtagaagatggataagtttttctgaactttatcaatttacaaacttacattttaggatattctgaagaaattaactttattacctaattttcaagtctaaagtttatcatataatagctgtccttcttatcattatttttgtttggtcatttcttatcttacctagcttcttggttagtaacttaaaggaaaaaatttttacattggcaaatcatattttttgccc

SEQ ID NO: 88684 - DNA, 106 bp, Homo sapiens
aggagaaccgacattgggtgggaaaccagcagtttctgctctgatgtctttcagaatgaatactttgatcaatatggtaggaagttagatttggggatggtttttg

SEQ ID NO: 88685 - DNA, 304 bp, Homo sapiens
actgcactccagcctgggcgacagagcgaaactccatctaaaaaaaaaaaaagatgtaaaaaccactcttacctggcagggcacacaggccacgaacagtagtttgctgactcctgcactgggggaaagtcaatccaaagctggggattggattgctagaagctttgtgcctaaacatgcccagaagtgacacatcagaagcaggtccttaaccatcatctaggtagagagagaaccgacgacagtcaataaacactgagtctggccaagttctgccatgtgccaatgtgcgtaaagagggaat

SEQ ID NO: 88686 - DNA, 215 bp, Homo sapiens
gcctgggtgacagagtgaccctgtctcaaaaaaacagtgattgtttgtaaggaaattattaaaaccttggttcaatatccaatatcttaactttaaattttcaaatacttcaaaactagtaagtattactatgcctaaagcacagtgcagtccaacggaatatgtgagccacatatataattttaactaggccagtagtcacattaataagaaaa

SEQ ID NO: 88687 - DNA, 325 bp, Homo sapiens
tgagccgagatcgcgccactgcactccagcctaggcaacagagcaagactccgtccccaaaaaaagaagaaaaagaagaaaagaaatgatgtaaatcagctgcccttcactctgtgttgaggtgggggatgtccctaattgcagtaggagagagcctctcttttatctgggactaaaagcccttgccctacatacctcataattattttagggttaactgattcaattgtcagaaaagaacaagctgtatcttgtttctgtacatattctactttgtgagtatttttatttcattgctatgtgattggaatcaactcaggaaaga

SEQ ID NO: 88688 - DNA, 483 bp, Homo sapiens
tgatctagaggatcccatccccgggtctgggtatctgggactacaggcgcctgccaccatgcccggctaattttttgtatttttagtagagacggggtttcactgtgttagccaggatggcctcgatctcctgacctctcgtaatccgcccgcctctgcctctcaaagtgctgggattacaggcgtgagccaccgcgcccggccagatctttacaatcagagatgcaaaactgattcattaatcatcaatgttgctgccagttgaaaatatctaagtttttatcacatccctaccctatcttgaccagtcaaacttgtctaaggcttccccttatgtctgaatatgtccatttgtttaatctaaataatgtcaggttgtgttcatttgtttctcttcccttctaaaacttgtctccatatgcctacttactgaaaataccattcctatacttaagagactaattaagtcaatctttttatggc

SEQ ID NO: 88689 - DNA, 393 bp, Homo sapiens
gctgtgtttgcatagtaaatgcagtctatatatattatatatttatttgaggcaattttgcagagaggctcgtgtggaatataggagagtggctaaacacctcctctgagctgctgttggtactaccaagggaacagtaaagacaactctaagtagaaggtggaaagttctgaaggagaggtcggaaaaaagtggccatggtgtttcgaaggactggaagatgccgtctgagagactgggagaagggtttcagtgaagaaactgcatttgagatgggcttttgaggccaagatttccacagggagagatcaggggagaaacggtctggaaggagggtgccgcctaagcaaagacacagggggacaaagcagaggactgatcaggtatccagag

SEQ ID NO: 88690 - DNA, 301 bp, Homo sapiens
aagatgatacactagaatcagagagagtaacaaagagacagacccggtggaactgattctaaggtgtttagagtaggcctgggagtttgacggtgcagtcagggaaaggacaaaccaggctgggaggatgaatagggtacaaatagcaagtgctgggaggcctgtcaggcaacaaggagccaaaggagcagaagcacctggaggcctggggcaggggtaagagaggaagtggagaattgagggtggagggagagggtaagaatggaagtagagaattgagggcgggaaggttatggccacc

SEQ ID NO: 88691 - DNA, 499 bp, Homo sapiens
caattttttccatgcacggttggttgaatctgaatggggaacctctgggtatggagggcagctgtgtatgacttttctcatagttttatgatttcctcatggatgctcagagtggattcaccaggtcaggtgtgaatacttctgtggctcctgatacccggcgtctgcctcactgctctctaaaagcgttgttttggttgacagaacccttcactgctcacggggttcacggctcctcatgagcagttggagtccctctccccaccatttttcttaggtttggggagctaatttagtagctaaagatgttactacctcacaattattttcattatttaacaactgccattgttgagcttttttgttgtatgtttgtttactggcaacgtttcctctttgttaggtctgtttaagacctgttctctttaactgttggaatcacttagccttttcttattgaattacatgggttctttaataaagagataaatcctttgtc

SEQ ID NO: 88692 - DNA, 370 bp, Homo sapiens
gaatgcgcgtgtgcagaagcacctgaaggccctcacttcggagctggccaatgccagagatgagtccaagaagactgccaatgacatgatccatgctgagaacatgcgactgggccgagacaaatacaagaccctgcgccagatccggctgggcaacaccaagcagcgcattgacgaatgtgagtctatgtaatgggcacccagcctctagggacccctcctccctttttcctgtccccagcctgtcttgcctaattatccaccatttctgaactgcctgggctcctcttcccttccacgcctttgctcaggctgccacctctgcctggatttcctcccaggtctgcccgcccagtgcccagcctaaaga

SEQ ID NO: 88693 - DNA, 275 bp, Homo sapiens
gcccacacctcaaggtccatcagagagagggggcgtcctatgtcatgaccctgctgagagctcacactgcccgctgggcccaggccctaggttctaccccgtgtggtgcccctccccttcccaaccactcgcacacctgtccccagcctgtcttgcctaattatccaccatttctgaactgcctgggctcctcttcccttccacgcctttgctcaggctgccacctctgcctggatttcctcccaggtctgcccgcccagtgcccagcctaaaga

SEQ ID NO: 88694 - DNA, 678 bp, Homo sapiens
aggacagttaggccacccagaaattagaaagagcaagaaaccactcccactaaggccagagggaggagatgttacaggcaccaagatttagagaatcttaccaataaagggttttccaaggccaggactagggtgaggggagtgaaggccaatgaggcaaaatttaaggaagctgtgcagggccctcacagaaccctcagagcgaatgcctcctcaaattgtgtcccagtgatacttcactcacccaactgtagtcccagccctggctgaaactgtctctttcacatgcagaactccttaaattccatgaaaaacagtactatagccagactccatttatgtgatttatagatactaccttatttatctctctcaacaactttatgagataggtaatattattatccttatttacagttgagaaaactgaggcacagaggcattaacttgcccaagatcatacaactggtatgtggtggcactgggacatgaatttagttcaagaagctgtgctcctaatcactgcactcttttgccactaccatatatctcaaattcaatgtctaaagcaaaatttcatatctttctgcacaaactgtctcacccttcacagttcttatttctgtcagtgtttccacttcttttacagttatccactctctcggcgagaccttgaac

SEQ ID NO: 88695 - DNA, 2140 bp, Homo sapiens
tagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgaacaatttttaaattacacttaacatgccaggtatctaggtatctagtgcttttagcaatattatcaatattatcaaggtcccagcttctttgtgtccttcccccttgcgatcctcttttttttttttttttttttgctttttaaaaaatagtgacagaagtctcactctgtcgcccaggctggagtgcagtggcagtcttggttcactgcaacctctgccttccgggttcaagcaattctcctgcctcagcctcccgagtagctgggactacaggtgtgcgccaccacacttggctaatttttgtatttttagtagagatggggtttcaccattgttggccaggatggtcttgatctcttgatctcatgatccacccgccttggcctcccaaagtgctgggattacaggcatgagccactgtgcccagcccttttttttttttttttttgacggagtctcgctctcttgcccaggatggagtgtagtggcacgatctcggcttactgtaacctccacctcctaggttcaagcaattctcctgcctcagcctcctgagtagtggggattacaggtgcccgccaccatgtctggctaatttttgtgtttttagtagagacggggtttcaccatgttggccaggctggtcttgaactcctgacctcagatgatccacctgccctgacctccgacagtgctgggattacaggcatagccaccgtgcctgaccagggctcttttagcaaggaaaacgtgaggaatgaatggctgttggtgtgcaacaaatcatacttgctacatgttgtgaaacctgaagttatttgttagtctgtatgaagaatgtaccccagagatgcaccctgtatctgccttatgtctcttacaatggaggttctctcctgttatattgctgaataaactatgtgaactgctaaattgactgaagactagttagtttatcactaactctttaatgaagaatttcactatcctacaactcctcctaaaaagtgaaaatttactttggagagagtgctttcgagaatagtattatgatcagtattattgcccctaaattttttaattattagagaatgcttatgttacaaggacatatactaagaaacattctacaaatgtgaaaatttaaatatcagcaaaatagagaaaaggtttttgtttttgttttagtcaatatctccattaaatagtaagatcagattaaaaggatttatatcattgatttctcaaatcaatacctaagcagtacctgtgagagcttgtttaaaaatggagatttcttggtctgctttagaaattttgattcctcaggttgcttgtagggcccaggaatctgcatattataaataacacctcatgccgggtgccatggcatgtacctgttaccacagctacttcagaggttgaggcagcaggatcacttgagcccaggagttcaagaccagcctgggcaagatagtcagaccactgtctctttcaa

SEQ ID NO: 88696 - DNA, 940 bp, Homo sapiens
aactcagaacgtggccgggcgtggtggctcacgcctgtaatcccagcactttgggaggctgaggcaggcagatcacctgaggctggtcttgaactcctgacctcagatgatccacctgccctgacctccgacagtgctgggattacaggcatagccaccgtgcctgaccagggctcttttagcaaggaaaacgtgaggaatgaatggctgttggtgtgcaacaaatcatacttgctacatgttgtgaaacctgaagttatttgttagtctgtatgaagaatgtaccccagagatgcaccctgtatctgccttatgtctcttacaatggaggttctctcctgttatattgctgaataaactatgtgaactgctaaattgactgaagactagttagtttatcactaactctttaatgaagaatttcactatcctacaactcctcctaaaaagtgaaaatttactttggagagagtgctttcgagaatagtattatgatcagtattattgcccctaaattttttaattattagagaatgcttatgttacaaggacatatactaagaaacattctacaaatgtgaaaatttaaatatcagcaaaatagagaaaaggtttttgtttttgttttagtcaatatctccattaaatagtaagatcagattaaaaggatttatatcattgatttctcaaatcaatacctaagcagtacctgtgagagcttgtttaaaaatggagatttcttggtctgctttagaaattttgattcctcaggttgcttgtagggcccaggaatctgcatattataaataacacctcatgccgggtgccatggcatgtacctgttaccacagctacttcagaggttgaggcagcaggatcacttgagcccaggagttcaagaccagcctgggcaagatagtcagaccactgtctctttcaa

SEQ ID NO: 88697 - DNA, 901 bp, Homo sapiens
tagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgaacaatttttaaattacacttaacatgccaggtatctaggtatctagtgcttttagcaatattatcaatattatcaaggtcccagcttctttgtgtccttcccccttgcgatcctccctgcctcagccttccgagtagctgggattataggcatgagccaccatacctgactacagtatattttgaagtactgtataaaggtactttataactattttttcttttctttttctttccagaccagcctgggcaacatagcaa

SEQ ID NO: 88698 - DNA, 683 bp, Homo sapiens
  misc_feature (648)..(648): n is a, c, g, or t
  misc_feature (656)..(656): n is a, c, g, or t
  misc_feature (658)..(658): n is a, c, g, or t
  misc_feature (663)..(663): n is a, c, g, or t
  misc_feature (671)..(671): n is a, c, g, or t
tagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgcactccancctgggcnanagagngagactcngtcaaaaaaaaa

SEQ ID NO: 88699 - DNA, 2579 bp, Homo sapiens
tagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgaacaatttttaaattacacttaacatgccaggtatctaggtatctagtgcttttagcaatattatcaatattatcaaggtcccagcttctttgtgtccttcccccttgcgatcctcttttttttttttttttttttgctttttaaaaaatagtgacagagtcttgctgtatgacccaggctggtctccaactcctaggctcaagccatcctcccacctcggtctcccaaggtgctgggattacaggcgtgagccaccctacccggcctaggatccatgtttgctttttatcgttaggtttttttttctcaatgagtacaatatgacttcttgttgtaacagacattttaatccctaggaaaggctggaagtagagagcaaaaggctttctttcaagtcagtgttttatttgggaatcaagtctttcccaaaaatccctagcaaatttcttcttacatctcattagaaagtaccagtttacaagggagcctgggaaaccttggcaaaggggaatagggttagcattgcctgggtaggccacattgcctccattgaagaaatcagggcttttttttttttttttttttttttggaaaaagagtctcactctgtcgcccaggctggagtgcagtggcagtcttggttcactgcaacctctgccttccgggttcaagcaattctcctgcctcagcctcccgagtagctgggactacaggtgtgcgccaccacacttggctaatttttgtatttttagtagagatggggtttcaccattgttggccaggatggtcttgatctcttgatctcatgatccacccgccttggcctcccaaagtgctgggattacaggcatgagccactgtgcccagcccttttttttttttttttttgacggagtctcgctctcttgcccaggatggagtgtagtggcacgatctcggcttactgtaacctccacctcctaggttcaagcaattctcctgcctcagcctcctgagtagtggggattacaggtgcccgccaccatgtctggctaatttttgtgtttttagtagagacggggtttcaccatgttggccaggctggtcttgaactcctgacctcagatgatccacctgccctgacctccgacagtgctgggattacaggcatagccaccgtgcctgaccagggctcttttagcaaggaaaacgtgaggaatgaatggctgttggtgtgcaacaaatcatacttgctacatgttgtgaaacctgaagttatttgttagtctgtatgaagaatgtaccccagagatgcaccctgtatctgccttatgtctcttacaatggaggttctctcctgttatattgctgaataaactatgtgaactgctaaattgactgaagactagttagtttatcactaactctttaatgaagaatttcactatcctacaactcctcctaaaaagtgaaaatttactttggagagagtgctttcgagaatagtattatgatcagtattattgcccctaaattttttaattattagagaatgcttatgttacaaggacatatactaagaaacattctacaaatgtgaaaatttaaatatcagcaaaatagagaaaaggtttttgtttttgttttagtcaatatctccattaaatagtaagatcagattaaaaggatttatatcattgatttctcaaatcaatacctaagcagtacctgtgagagcttgtttaaaaatggagatttcttggtctgctttagaaattttgattcctcaggttgcttgtagggcccaggaatctgcatattataaataacacctcatgccgggtgccatggcatgtacctgttaccacagctacttcagaggttgaggcagcaggatcacttgagcccaggagttcaagaccagcctgggcaagatagtcagaccactgtctctttcaa

SEQ ID NO: 88700 - DNA, 1129 bp, Homo sapiens
  misc_feature (1094)..(1094): n is a, c, g, or t
  misc_feature (1102)..(1102): n is a, c, g, or t
  misc_feature (1104)..(1104): n is a, c, g, or t
  misc_feature (1109)..(1109): n is a, c, g, or t
  misc_feature (1117)..(1117): n is a, c, g, or t
tagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgaacaatttttaaattacacttaacatgccaggtatctaggtatctagtgcttttagcaatattatcaatattatcaaggtcccagcttctttgtgtccttcccccttgcgatcctcttttttttttttttttttttgctttttaaaaaatagtgacagagtcttgctgtatgacccaggctggtctccaactcctaggctcaagccatcctcccacctcggtctcccaaggtgctgggattacaggcgtgagccaccctacccggcctaggatccatgtttgctttttatcgttaggtttttttttctcaatgagtacaatatgacttcttgttgtaacagacatggtggcgggcacctgtaatccccactactcaggaggctgaggcaggagaattgcttgaacctaggaggtggaggttacagtaagccgagatcgtgccactacactccancctgggcnanagagngagactcngtcaaaaaaaaa

SEQ ID NO: 88701 - DNA, 7679 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagcaaaaaaaaaaaaaaaaaaaaaaaaaaaaaaaaaaaaaaaaaaaaagaaaaaaaaaaaaaacaaaaaaccaaaaaaaaaaaaaaaaaaaaaaaaaaaaaaaaaaaaaaaaaaaaaaaaaaaaaggggggggggggggggggggggggaggagcaaggcgcaccggggggggggggggggcatcgtaaaagatattaaaaaatttactgaactatccatatgctcacccacagaaatccggaaaggctccttttctaagaataaaaacgggggggaagacagagcgagagtgaagtaccacggggggaggcgggcggacggagagggtgggggcggagaagctcacgcgaggcaggagcggcggacggcaggcgcttaattgtacactacacgacgggcggcgggggggagggtggagctggtgacgggagagg

SEQ ID NO: 88702 - DNA, 3858 bp, Homo sapiens
ccacctacccactggccttcctccccagatacccagagcagcaccagggcagcccggcttgggcggccccccaagtccttgcctaccccctgccacagctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88703 - DNA, 3509 bp, Homo sapiens
gggaggccgaggcaggcggatcacctgaggtcgggagttcgagaccagcctgaccaacatggagacactctgtctctactaaaaatacaaaattagccgggcgtggtggtgggcgcctgtaatcccacctcgtgaggctgaggcaggagaatcgcttgaacctggcaggcggaggttgcggtgagccaggatcgcgccactgcactccagccggggcaaaaagagcaaaactccgtctcaaaaaaaaaaaaaaaaaaaaaagcagggggcggtttcagggataaaagtggggaatcctcggagcttttccagccggccctcccggtcgccctttgcagtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88704 - DNA, 7305 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagacgaactggccaatgagatccccgtccccgaaactctggattccggggcccttcacaggcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88705 - DNA, 7142 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaagccagggcacgtcaaagttgcggatcgtcccaacaaatgtaagaaaacagacactaagccaaaaaacaaaaacaggcaagaagagaaaacagaacgaaagaaacaaagaacacgacacaaacaacaaac

SEQ ID NO: 88706 - DNA, 6959 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgacggccactgacaagcgcgtcagcgcgcagcttgactatagaggc

SEQ ID NO: 88707 - DNA, 1367 bp, Homo sapiens
accccggcaacacgcctggctaatttttgtagggacggggtttcgccatgttggccaggctggtttcgaactcctgacctcaagtgatccacccacctcggcctcccaaaatgttgggattacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88708 - DNA, 1166 bp, Homo sapiens
cagctggtccggtctggggtgtagggatgctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88709 - DNA, 3332 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88710 - DNA, 2941 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccagggtgaggcctgacggccactgccccagaactgaccaggaaggcctgacgctgccctaaa

SEQ ID NO: 88711 - DNA, 233 bp, Homo sapiens
gtgaggggtgtgggatgtgaaggggagtggggaggaggcctcgccttgaacatccttgttctctgccccaggtctgtgggtcagatggagtcacatacggcaacgagtgtcagctgaagaccatcgcctgccgccagggcctgcaaatctctatccagagcctgggcccgtgccagggtgaggcctgacggccactgccccagaactgaccaggaaggcctgacgctgcccta

SEQ ID NO: 88712 - DNA, 7248 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88713 - DNA, 7411 bp, Homo sapiens
tgcccgctcctatcgccgcttccgcctctgccggggacggggacagcagaccctcggcgcccggcccccgcgcacctgccgcgcgcaccgcctctccggcctgcgcggctccgggggctccgggaagaccgagcgctggcggccagcccggggaggctgtgggcagcaggggtagctgcgggctcccagtccctcctccgcctacctcggagcccacatttgggatttctactccgggagaattctgccctcctcccacgatgagcctggaggactggagccgggacctggcacccccagggctgtgactgggtgaactctgagggcacagctgctgtccgccgccccaggggtcccaggatggggcgagcagccctgaagaggcccaagggcaccccgtgaggagcccccacgctctgagagtggggcgcagagccggagccccgggccatgcctccgctgccgctggcgcgggacacccggcagccgcctggcgcctccctgctggtgcgaggcttcatggtgccctgcaacgcctgcctgatcctgctggccaccgccacgctcggcttcgcggtgctgctgttcctcaacaactataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88714 - DNA, 7701 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctgggggtgagcagggatcaaggacttggggtgggtgggcaggcgccgagaggctccaccagagcctgggctcagagcgcgtctccccagggctcgagcccttggagggcagcagcgtggccacccctgggccacctgtcgagagggcttcctgctacaactccgcgttgggctgctgctctgatgggaagacgccctcgctggacgcagagggctccaactgccccggtgagtggacggctgggcgaggggagtgtgaggatagcctgggctcggccgaggtgctgccccctcgcctgggcagcaggtcagtgccgggggttatggtcttggggctcggccccctcaaacacgtgcgtgccggggaccccacgcctaacccgtctctctcgttgcaagccggcgtggcacactgctctgaggagtcctcctggtaaccgacaccagccccaccctggggtccccactaacctcatgaccatctgactaacatccaccttcccttgcacccttgtggcttgctgctggggcctgtgcctgggccagcctggatgccaggcagatgccaggcagggcctcactgtacctcccccacagccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88715 - DNA, 5733 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88716 - DNA, 1818 bp, Homo sapiens
aagcctaggctaggtacgaggctgggtttatatcggccgcagggagggccgctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccctatttgagctgctccttcctgtgtgtgctctggaccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88717 - DNA, 6475 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggatttccggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccaccctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggatgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgctgagggatggacaggcgaggtggcagcgtggagggctcggcgtggatggcagcctcaggacacacacccctgcctcaaggtgctgagcccccgccttgcactgcgcctgccccacggtgtccgcgggaaaagccgggtctgattaacctcgtccgagggggatcggtccaaagagagggtgtgaggctgaggggcctctccggggaaccc

SEQ ID NO: 88718 - DNA, 3938 bp, Homo sapiens
gcgggccgctgctgcctctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcgcgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctgggggtgagcagggatcaaggacttggggtgggtgggcaggcgccgagaggctccaccagagcctgggctcagagcgcgtctccccagggctcgagcccttggagggcagcagcgtggccacccctgggccacctgtcgagagggcttcctgctacaactccgcgttgggctgctgctctgatgggaagacgccctcgctggacatgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagca

SEQ ID NO: 88719 - DNA, 414 bp, Homo sapiens
tcaaaaccactaactagcggccgggcacggtggctcacacctgtaatcccagcactttgggaggctgaagtgggtggaccacttgaggtcagcagtttcaagaccagcctggccaacatggtgaaactccatggtgaaaaatcagccggaccgcggtgggcacacccgtaatcccagctactcgggaagctgaggcaggagaatcacttgaacccggcgggcagaggttgcagtgagccgagaaagcgccacagcactccagcctgggcgacagagcgagactccatttcaaaacaaaaccaaacaaaaaacacgaactggctcttatcttgaatgagttattttttctgagcctttatttcttcgtttgttcaaatagcgaccattaaactttgtgtttagtatctgacaaac

SEQ ID NO: 88720 - DNA, 255 bp, Homo sapiens
gatcagaaacatttacaatctattctctctgaagcctggcacctggaggcgtcatctgcatgagaattttggactccacaaccttttatcataacccagacattcctttctattgataataactcaaccaattgccaatcagaaaaattaaaaatctacttataacccagaagcactaccccgcaacccttgcttgcttcaaattgttccaactttctggaccgaaccaatgtatagcttaaatgtatttgattg

SEQ ID NO: 88721 - DNA, 624 bp, Homo sapiens
tatcattgttcacatgtcagttggaacaaagctgggaaactaacctttttgagcattgacagtatagtcagacacatccacgaatctcatcaaatcatacaagcctgaaggggaggtattcctctaactggttttatagatgagacagtcgttgtgcagagagattgaggggcttgctcaggatcttgggactagaaaatggtggagcttgtaggctatgacccaaccaacacctatgctctttcctccaagaattaagattgcaatttgaattttcactattagtttcaataatgagcatatgaagaaagcaagcaagtcagaaaatttaaaaatgaaattatcacaccttgtaaagtgttcagatttgacttgaagtttaaagtcttttgtccatttcagtatttcctgtttctttgtaaatccgtagaggatagacgtgaactccaaacctttacactggaagagagaggcatgaactttactgaatacttaatatgtggcaggcagtgagctaggggcttttcatacgttattaactcacttggatttcacaacaacactatgaaggtggaggttgaagttcattctgtttttctcagaacttggtcagcaatgtctata

SEQ ID NO: 88722 - DNA, 726 bp, Homo sapiens
ctcactgctccccttccccatcccgtcctcctccacggctccccttgcttcacctcacaggggctggaggggggcagtgggtgatgggagggaccagggtcctgcagaaggagctggaccctccctccctgttgctactcccgtcccccgaactcactccccacctgtgccgagctccagaagggcgtgcttctgtgctgccctgcacgtgacagtctcagcagacacccactgggattgtcagggcggtgtctctagggggccctgtctgtgcccagtgctgttccagtgcgggggccagccctgaataaaagaccagctgtctttaggaggctcgcacaccaatgggaggagacaggcaagccagacaagcaaggtggcaggcacagctctgggtgcagcggtgtggggttacagcctcacagggggccaggctggcagcctggtgtgggagctgagactgcctgttcgatgagaggcgttccagcaaagacacaaggagagtgagccctgggcacctgtggaggaggctcaggagggagctgtgagcgtagaggcccagaggccagggtttgtttaaggagtgagtgagcggagtgagaagaaagggccaggtggtggctcacacctgtaatcccaacactttgggcggcccaggcaggaagatcacctgaggccaggagttcaagaccagcctgagcaacgtagcaagacaccatttctacc

SEQ ID NO: 88723 - DNA, 478 bp, Homo sapiens
caggggacatgcctggctccgtctgggtgccaggcccagagccgggcattttcccatagtcatcggccccctgcccgcccccagcatgtcgaggaagggaggagtatttttagttccatcttgaagacgggcacaggaacggagaataactgcctgaaagcactgtccctggtctgagcggcccttggaaaggctcagcctgggcccaggccttgctgcttcccataacagttacaagcactggctctgcattcggagatgaaagggtacacgtggggttctccgaccttccagccgtgtgacctcggactagacctctgtttgcttagctccctccacttgccttcctcgaatgtggggaaccccggaatctgtcttgggaaaagacctggcctctccttctctgggttgggtccatccatgggctcccgcagaggcctgtggttgcagagaccggaagctgcagcttcaggagggt

SEQ ID NO: 88724 - DNA, 613 bp, Homo sapiens
cccgaatctgaccttccacatccccggcaccttcctggaagacccacgtgggaagagcatggaggggagaccccagcatcgttccagagccaggtctggaggagccacctgagctgctgtcattccaccccctggcggtttatactgccttcttgatactgccacctccagtcactggtgttgggcttctgaggtgaccactctgccttcctgggggtacaggaagaccaaggtctacagaagcaccttccaggcttgagctcgttcacagcctgcctggccctgggctggggaacaggcagggagcagcctctggctccagagcagggtgggtctcaatgcatcacatccgtccttccggttcccagcagagcctttgaatgctctgcctcagatctgcagccagaggaaaagggggagtgggcagggcagactcagtctagggacgagctatgcagcacagccagtgccagctccccacgtgcctccccaaccagggtgataaaggctgacacctgggtgtgtagctgggtctggcccccagggcatcacagtgaccggggcaaaagggtcccacaagcgcacaggggtggaggctgatggcagagggaag

SEQ ID NO: 88725 - DNA, 318 bp, Homo sapiens
cacgccattctcctgcttcagcctcctgagtcgctgggactacaggcacccaccaccacgaccggttaatttttttgtatttttagtagagacagggtttcaccatgttagccaggatggtctcgatctcctgatctcacaatccacccaccttggcctcccaaagtgttgggattacaggcgtgagccactgcgctcggcctctagccacaatgtggttataattgtgaatgggatattcacaattataaagatgtagcaacctgaaaatgtctaaaaacagaactgtttgttgactgtctacctccaccccctcac

SEQ ID NO: 88726 - DNA, 603 bp, Homo sapiens
aataatttctctcatactgcttttaactcatttaatttttcaactttttaagaataacaaaagtgatattaattgtaaaaatgctgaagtgacatatgaatttatgaagtgcatatgtattttttagtttaccaatgagatgggagaaatgctgtcttatattttaacatacattttggccattacacagatgaagcaacttttcatttgttaatacataatgcatactttttcttctgtgcaattcctctttgtattctttgctcattttcccactgggatttgcaagttctttattatttgataatctctatacattctgaatatcaattttttgttatatataccatgtaaatattttcttctaatttgttatttgtcttttaatggtatttatcaattgtttgctaaaaatgagtttgtttagttagtaaaatttgtctatctttaacttcatgatatttgtatatcatgtcatgaggaaaaggcatgaatattttaaaaacttccttgtagtgttaattttattttttatttcattctttaagttatttgaaatttattgtttatttcttcaaattccaaataataaccaactttctc

SEQ ID NO: 88727 - DNA, 700 bp, Homo sapiens
  misc_feature (294)..(294): n is a, c, g, or t
  misc_feature (537)..(537): n is a, c, g, or t
  misc_feature (539)..(539): n is a, c, g, or t
  misc_feature (552)..(552): n is a, c, g, or t
  misc_feature (680)..(680): n is a, c, g, or t
tggatatgcaggatatctgggtaaaaaaaaatatgtatacattatttgaggcatctcttaaatgtatacaaagacaaatactctaaggctgccattgtttagaagtctcaatcatattaaggaaaacactagaataaaaattaataaatgtagtgacactggagtctgataaacctgtatttgaatgaccctgagcaaccttatttttgttctttttcattgactctaaaatgtagatggtaatgcttaccttataaggttactgtgaggacttagtgaaataatacatggaangtgcctaacctaggatcagaatcaaggtcagtcctccttccctcaaatgttagcttccttttctacctttttttctcttcacttcccttagtatctataaaaagtaggaaagaagaggatacttttttttttcatattcctacaaggctgttttaagtaatgttcttttagttgaatgacagtcacatcatttgagaggttagtctaataatagcactggagacttgaggatgacaagtgcgnantttcagttgggtntggactccaatttatttatttatttgtttataatcaacatggatttatttgcacctgaccacttttgacagaattaaaaggagaaattgtagacttctacaattacattcacagatttgtgcactacngtctcagaaacttaggaagc

SEQ ID NO: 88728 - DNA, 1650 bp, Homo sapiens
caccagccagcctctgggtctgtagcaaccgcccagcgttgaggcgcggctcatgcccccagtatcccggtccagctattccgaggacatcgtgggctctcggagaaggcgacgcagctcctcggggagcccaccatccccgcagagcagatgttcctcttgggatggctgttcccgctctcactcccgcggccgtgagggcctcaggcctccttggagtgagttggacgtgggcgctctttacccctttagtcgctctgggtcgcgagggcggctcccaagattccgcaactacgccttcgcgtcctcctggtcgacctcgtatagtggatatcgctgccatcgtcactgctatgcagaagaacggcagtcagcggaagactacgagaaggaagagagccatcggcagaggaggctgaaggagagagagaggattggggaattgggagcgcctgaagtgtgggggccgtctccaaagttccctcagctagattctgacgaacataccccagttgaggatgaagaagaggtaacgcatcagaaaagcagcagttcagattccaactcggaagaacataggaaaaagaagaccagtcgttcaagaaacaagaaaaaaagaaagaataagtcgtctaaaagaaagcataggaaatattctgatagtgacagtaactcagagtctgacacaaattctgactctgatgatgataaaaagagagttaaagccaagaagaaaaagaagaaaaagaaacacaaaacaaagaaaaagaagaataagaaaaccaaaaaagaatccagtgactcaagctgtaaagactcagaagaggacttgtcagaagctacctgggatggagcagccaaatgtggcagatactatggatttaatagggccagaagcacctataatacatacctctcaagatgaaaaacctttgaagtatggccatgctttgcttcccggtggaaggtgcagctatggctgagtatgtaaaagctggaaagcgaatcccacgaagaggtgaaattgggttgacaagtgaagagatcggttcttttgaatgctcaggttatgtcatgagtggtagcaggcatcgcagaatggaggctgtacgactgcgtaaggagaaccagatctacagtgctgatgagaagagagctcttgcatcctttaaccaagaagagagacgaaagagagaaagtaagattttagccagtttccgagagatggtgcacaaaaagacaaaagggaaagatgacaagtaaggacttacttgttgcacagcaggaattttaacaacaaaaattttatgtgaccaaaagtgttaaaaggctttacagtgctactgtacttaccatattagtaagtccctcaggaaaaagcttcttttgagatatctttagcagcttattttttgttattttaactttaaaaagtaatatgtgcacatggttttaaaaatattcaaccattataggaggagagttagtaaaaagtgaatctttcactttagcccctgacacctttcccccaaaaatatatattttggtgtcttatatacagaatatacattctgtgcatatacaagagtatatgttgcagcataaagattaaaagctattaaagttttttttcgctcgttaaaaatttgc

SEQ ID NO: 88729 - DNA, 465 bp, Homo sapiens
aagacaggttaggccagattccattatgcttagaaagccagatttgggaagcataacccactatgggagtgtcctgggaaacctcaattactgtgatctccacagctttaccgtaatccagccttggaaattcaggaatgagagagatgttctcccccttttataaccctgttgagtgccatccctaagctaactaaaattagacatgactatgaattccaataatttgctggtaggagaataaataaagactttgcaagtttatgcaggttatgagagcaaaggttagctgacagaacagcagcaacatctttattgagcataaacaaatcatttatccctccttctgctcccctgttacatgtttaaactcagggaaaccacgataaaaccctgcagatagagctaggattattcaccccagcgatcctaaatcacacaaggcttgtatctcacagcttatag

SEQ ID NO: 88730 - DNA, 388 bp, Homo sapiens
ggtgtcgatctaaggatccctgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaaggcagggaagggaggaaagaaaaaacagaacaagcaagacaaacagagtccaaacaaaagagaagccagaaattcaaatatacccaatcttatatacagacaagtggacacgtgtttcaggtaagagtcagagatggaaagcctgacctcacaacagcacccgac

SEQ ID NO: 88731 - DNA, 144 bp, Homo sapiens
acagcacagaggaggagacaagcatctaatgatgacattctggtctcgtcttccgtctcccccgtgttcccctcttgtctcccctgttcccctctcccttccctcctcccatgtcactgtgctgtgggatcctctagaacagcc

SEQ ID NO: 88732 - DNA, 262 bp, Homo sapiens
cttagtctctccagtcaggacataaggctatctgcttcccctctccagtcaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataa

SEQ ID NO: 88733 - DNA, 690 bp, Homo sapiens
gtgaagagcagggccagggtgggtcgagggctcttttaagtacttagggagatgaccttgtctttgaccagactgagatagcagcttacagagggagcgagaaaccctgaacatggagaagatttaaaaggtagcatggggttggctctgacagtataccttctctctgaatgagtcttttgtgtccttctcttcaggttcagattcagaacaagaaagtggacatctctaaggtctcctccaagtgtgggtctaaggctaacatcaagcacaagcctggtgagtggtgcctcccttgcccactgggtctccagggtatgtcgtcctgccatgggtcagctgggcagccagctggctggcaagggtttcatctctgtgcctttagcatcccatgaagactacccaggacaccacagtcctcattctgtcagggagcaggagttcgggtgctaacctctaagtggaggaggagcagtttcttacagcagccatctgcacaggcattctcttgagtacctactgtgtgtgtggaactattgagctaggcctggggaagtggtgcactctgagctgagaacctggattggctctaaacgaggattacagaagctactgctgaaggagctgtatagcagggcagtgttcaggtcccacctatcagatgcaggagcaaagggtgctcccaaccag

SEQ ID NO: 88734 - DNA, 1026 bp, Homo sapiens
tgagacacgaggaacatggaataccatactgaacaccagctccgtctcggcggcggcggagtctatgctacttctcgccagtgctggagtgcaatggcgcgatctcgtgctcactgcgatctaccgacctcctgggttcaagtgattctacacttcctcagcctcctgacttgctgagactacagattagagaactcagccctgaaaggtgactcattcaaggccacagcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgaatcactttaagatgtaacatgatgatgcacctggcagattatggtctatcactccaagtgctgacacgctgaatacttcaattattggcgggacaaaatatccactgacaaacagatacggatggtctccctgaaacaagctgagtacctaagatgtggcactgaggaaagccattcaactccccaacacctagagaaccataggaccccagcaggcgagtgagacaacacccacaagcaaggaagaaccgaacgagatagcaaggagaaaacaaggcacacaaaaaaaggaacacgccacacgagtgcacaagtaggacaggaacacaagacaggggcccgccaagaaacaacacggcaaca

SEQ ID NO: 88735 - DNA, 770 bp, Homo sapiens
gtgtgttcttcctggagaaatagattgaaattcatttggacagaaatgttgaaggcaggtgcctgatccaaaatgcatttagtcaggactgaacacaagctgcctggatagttcctgcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagacctcccactacccccacaccctgccagcctttcttttcatcttcctcttgatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacgacaggtgttgtactcagggtggtctggggaagcttaaatttcaaactcagagtct

SEQ ID NO: 88736 - DNA, 402 bp, Homo sapiens
  misc_feature (7)..(7): n is a, c, g, or t
  misc_feature (69)..(69): n is a, c, g, or t
  misc_feature (153)..(153): n is a, c, g, or t
  misc_feature (161)..(161): n is a, c, g, or t
  misc_feature (194)..(194): n is a, c, g, or t
  misc_feature (209)..(209): n is a, c, g, or t
  misc_feature (245)..(245): n is a, c, g, or t
ccttgcnaatgagtagaatttccccttctctccccttgtcaacaggtttaaaaacctcacagcttgtanaatgtaacccatttggggcccgcttttaacttggactagtgtaactccttcatgcaataaactgaaaagagccatgctgtctantcttgaantccctcatttaaacagaggtcaagcaataggcncctggcagtgtcaancctgaaaccaagcaataccgtcatgtttcagccaanccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88737 - DNA, 1644 bp, Homo sapiens
tgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggtatgtttctaaattttgcctccattgggaacaagcagacagcaaggaaggaaccaaagtgacagattaccggcagagcactaagcagctttttacagctgggttctgtgactgcctggggaaagcttaattcccttgtgttggaagcttgctgggagtgaggcaaggaagagaacaaagtgaatcttgcagggtcaagctgaatgtcttgctagcatgacagataatgtgaattgagtatgcaagtttggggtggaatggggtcagagaatggtgggtataaaaactagaccccctttcttgacctcatgtcaccctgtccaacccatcccccatccacccagccctcagctccctgttggtttgaaccagatgattcctgagctctaaatccttcaatcccaactgattgatttccttgcttgaaaatctgtcactttatatagattcacaatgggtttatcagcactaacctcctctcattaagttgcacaatctgggtggaagctctgttttctgtttttgcttttgagaacgttttacttttgttcaaactgaaaaagagccctttaaagctagctatttaatattctttctgtgttcttcatgtttgacccaatcttgcttctagttttctctttttgtatgtgttttgagaggatttgtggggagaaaaagaagaaagagaaagcagggagagaaggagagacttgcaacctaataaacagctaaattttgcggtctttgtgacagccttttgtg

SEQ ID NO: 88738 - DNA, 6270 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88739 - DNA, 5407 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataa

SEQ ID NO: 88740 - DNA, 6408 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcaaaaaaaaaaagcacaacaacaaaacacaagccaagacaaacagcaacacaacacacaacaaaacgacgggagggcaccagaaaagaaacaaccgaggggaacacacaagaagcgaagagacaaccagacaaagacaag

SEQ ID NO: 88741 - DNA, 6223 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacacgatcataggtcgggatcctgc

SEQ ID NO: 88742 - DNA, 6156 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88743 - DNA, 6174 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaatgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88744 - DNA, 6095 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacaccaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggagctgccccagacttggcctcctcatgccc

SEQ ID NO: 88745 - DNA, 5984 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagtgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88746 - DNA, 6225 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88747 - DNA, 5960 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcaagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88748 - DNA, 6129 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaatgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88749 - DNA, 5491 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggtaaggctcccaagggatcctcagagtcaccctcagca

SEQ ID NO: 88750 - DNA, 5496 bp, Homo sapiens
  misc_feature (5446)..(5446): n is a, c, g, or t
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatgtttgtgtttgaagctaagtgttattacaagagtcaaaaaatgttttaaaaactaaaaagtttatnaagtaaaagagttacagtaagctcaggctaatttattattgaaaaaataa

SEQ ID NO: 88751 - DNA, 5635 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagccgggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88752 - DNA, 5878 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccagcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88753 - DNA, 5090 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccagcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataa

SEQ ID NO: 88754 - DNA, 4035 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaatgcagattgagacctacaggctgacgttccgggcaaatgccagggcccgcaccgaccacggggccgacattgtctcccgcccccgagagagcggggaccgagctgagtat

SEQ ID NO: 88755 - DNA, 3885 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagtgcagattgagacctacaggctgacgttccgggcaaatgccagggcccgcaccgaccacggggccgacattgtctcccgcccccgctcctgagctgcagctcgctcctagagttagcagctcgctcctgagttagcagcttgcacctgcg

SEQ ID NO: 88756 - DNA, 3788 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagggcatcccagctaggccttgggatggctgcagtgaggagaaatcccgggaactgtattgacacaaagattcttattgcacttgtattttttgtattaaagtttgcatggtttctaataaaggattcaaacataa

SEQ ID NO: 88757 - DNA, 3697 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaaccttgtacgcgtacaaggccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggctgggcccaccgcccaccaatggcgtcggcacgtcgatgagtgtgtggagtccaccggctgtggagcg

SEQ ID NO: 88758 - DNA, 3191 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcagccacccgccccctccccccaacataacaaaaaaaacagaacataaaaa

SEQ ID NO: 88759 - DNA, 3466 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcaagcttacagtgcttgaatgaaacactcacatcatgcaccaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgcccaagatgttattggcaagcaaagagtctccaaaacttgaccctcatcaaaagatgacatatataaaaaggcatttgataagttt

SEQ ID NO: 88760 - DNA, 2827 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacgggcatcccagctaggccttgggatggctgcagtgaggagaaatcccgggaactgtattgacacaaagattcttattgcacttgtattttttgtattaaagtttgcatggtttctaataaaggattcaaacataa

SEQ ID NO: 88761 - DNA, 2851 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccaggtacgtgcttgtgcttattctcagtatttctctctaccaggttgtagtctcgagaagactaaggacaaacatcatgccaggtaaagtacagacagtcacactgtactttgcaagtttattcatactcctgctctcctagacaactctttcccgcctttaccctcctcccacctccaacaccttttctatgttcattctctgctgattgtcctgtttttcttgcagataagtcaagcaataaaatagaacatcgacaaacttctattccattatctacccaactacttgtatctgtatccatggtctctgcttatgaagttcccgtttttataagtaactgttccgctcctaattaagaccaacctctcctcattttgccctagattccatctcctctcttcctactcgatatattgccccatgtattcttcccttttttgcccctcataccaatttaaatctttctcattggatcattcccacccactaacaaacgtttca

SEQ ID NO: 88762 - DNA, 486 bp, Homo sapiens
aacctgggaggcagagcttgcagtgagccgagatcgccactgcactccagcctgggcgacagagagagactccatctcaaaaaaaaaaaaagaaaaagaaaaagaaactattccccattttctttctctatcctggtttcattccattatttattgagctcagaagaaagaaatgctaattttaagttgcatctatcctcattgcttataattttactttgaattgtgcaatttatactttttttaatttgtttttattcttgtctgtttgatgttgccctttaaaaaataaaaataaaaaataaacaacaatcaacctaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctg

SEQ ID NO: 88763 - DNA, 352 bp, Homo sapiens
gggtgggacatttctgtacttctcgatttgcttatggctcagccattacctgtgtcagtccatgattctgttgtaacagttttaagagtaaataaataaagctgcctgatgtcccatcagcaggcttcgtgcttctgtgtctcgttttgcatctaccacctccctggatcttcctgccctcagctcagcccctcagctgtgaacttgtggatgtggacacgggaaggaccactgtgccacatagccctgcgccttggctacctgtggaactctcccctagtctgcctgataaagggctacttgacacttacttgcttacttactgtccaaaactacaaggacagtgacagtt

SEQ ID NO: 88764 - DNA, 508 bp, Homo sapiens
gctgggcatggtggctcacccctgtaatcccagcactttgggaggcagaggcaggtggatcatgaggtcaagagatcgagaccatcctggccaacgtgatgaaaccctgtctctacaaaaaaatacaaaaattagccaggcatggtggcgggcatctgtaatcccagctacccgggaggctgaggcaggagaattgcttgaacctgggaggtagaggttgcagtgaaccaagatggcaccactgcactccagccttggcaacagagcaagactccacctcaaaaaaaaaaaagaaagaaagaaagaaatattaatctttctagttgcattcaccaggaatgagttttggatttcttctatattccagatccctttaagatgtaccatgatgatgacctggcagatttggtctttccctccagtgcgacagctgatacttcaatatttgcaggacaaaatgatcccttgaaagacagttacgatggcttcttcaaatggatttattctg

SEQ ID NO: 88765 - DNA, 4230 bp, Homo sapiens
  misc_feature (27)..(27): n is a, c, g, or t
aaacttaggctagtacgaggctggggngtgaatcggccgaggctacctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccagcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataa

SEQ ID NO: 88766 - DNA, 1336 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacaggaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctcc

SEQ ID NO: 88767 - DNA, 1387 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagacctcccactacccccacaccctgccagcctttcttttcatcttcctcttgatactccatcttctaaaccaacactcctagccaatggtggtcatggagtagaagggagcgatactacaggaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctcc

SEQ ID NO: 88768 - DNA, 345 bp, Homo sapiens
tgatttatcccctacacccaccagcacaaagagtacaaccgtgacacccatcaccaccaccactaccgtgttgggttttccccgtatgtctccctgcaacacagctgttgtacctcaggggtggtctgtggaagccttaaactctccacactcagagtcctttgtttccccagaggctgttgcagaacctcctcagccaacggcagaggtaaactattagagactccctttatcagttaatggttgcagtattggtaatcaatataaatcatcaggtgtattttttagcagcttacagcaggtataaaaatttcagaacaatcacaaatgttttgcttatattag

SEQ ID NO: 88769 - DNA, 1048 bp, Homo sapiens
gtgtgttcttcctggagaaatagattgaaattcatttggacagaaatgttgaaggcaggtgcctgatccaaaatgcatttagtcaggactgaacacaagctgcctggatagttcctgcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagacctcccactacccccacaccctgccagcctttcttttcatcttcctcttgatactccatcttctaaaccaacactcctagccaatggtggtcatggagtagaagggagcgatactacaggaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctcc

SEQ ID NO: 88770 - DNA, 6299 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcaaaaaaaaaaaattctaacaaacaaaaggg

SEQ ID NO: 88771 - DNA, 6328 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcaataaaaaataatacatggtttgacactttggcctattcttctagtaaaattattcttt

SEQ ID NO: 88772 - DNA, 5967 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaatgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88773 - DNA, 6177 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88774 - DNA, 5684 bp, Homo sapiens
  misc_feature (5506)..(5506): n is a, c, g, or t
  misc_feature (5590)..(5590): n is a, c, g, or t
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggtggccaatgggctcttnggccctctgacttggcctttttgtcggtctgggaggggggtgcctagttattggcccggggcggggggcggaggccccttgggnaggctgggggggcccctccccccagaggggtggggggggcggcgcctccggctctctgcgtttgcgtggttctcccttctgcgtgtgtctttcc

SEQ ID NO: 88775 - DNA, 6234 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgcctgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88776 - DNA, 5436 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataaaaaaaaaaatcacacaaggctacaaaaca

SEQ ID NO: 88777 - DNA, 5616 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88778 - DNA, 5470 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccgggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatca

SEQ ID NO: 88779 - DNA, 4607 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccgggcatcccagctaggccttgggatggctgcagtgaggagaaatcccgggaactgtattgacacaaagattcttattgcacttgtattttttgtattaaagtttgcatggtttctaataaaggattcaaacataa

SEQ ID NO: 88780 - DNA, 3858 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaaggtagcgagtgggtcactggggagacacagctggggaggggtgggaactatgcagttagggtcagggtcctcacaggtaggcacctgtcaccgcccctcagtctcttcaggagtcatgtcttca

SEQ ID NO: 88781 - DNA, 4033 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtgagtggtgcctcccttgcccactgggtctccagggtatgtcgtcctgccatgggtcagctgggcagccagctggctggcaagggtttcatctctgtgcctttagcatcccatgaagactacccaggacaccacagtcctcattctgtcagggagcaggagttcgggtgctaacctctaagtggaggaggagcagtttcttacagcagccatctgcacaggcattctcttgagtacctactgtgtgtgtggaactattgagctaggcctggggaagtggtgcactctgagctgagaacctggattggctctaaacgaggattacagaagctactgctgaaggagctgtatagcagggcagtgttcaggtcccacctatcagatgcaggagcaaagggtgctcccaaccag

SEQ ID NO: 88782 - DNA, 3527 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaattgtaagtataagctctggttagctggcatctg

SEQ ID NO: 88783 - DNA, 3005 bp, Homo sapiens
agcggggtctgggctcccagactctgagagagagcgacggccatcatagaacagcgagggcagtcgatcggcctgcggtccgcttcggcattcgcaggccgcaggcgggaggctagagcccccaggcgcactcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggatgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaaggtaagtggtcacctaactactgtgccgaggaaaattgttcccctctgagtgtcagatagacagatccttgttgctaacagacaacagaatcaggctggtggaattgggaaaaggcaagggaaatgggggagagggtgatttgaaaattggcatggctactctggacgcgctgcctatgggttagccctgctccacgaggagcagccaaa

SEQ ID NO: 88784 - DNA, 423 bp, Homo sapiens
ggtgtcgatctaaggatccctgcagcttgccggccgaggaggattctgtgttagaaaaactaggggaaaggaaaccatgcaacagtcaaccttctgagctttcttcagagacctcagccaacttcatgtattgcggtacccctcccacacaagccaaacaagtttgcagacccagtgaccgcaggtcaaccccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatg

SEQ ID NO: 88785 - DNA, 398 bp, Homo sapiens
cgagatcgcaccattgtgatccagcctgggcaacaagagcaaaactccatctcaaaaaaaaaaaaaaaaaaaaaaaagataaataaaagcttcaaatgaaaggccaattcagcacacccagcagcttgaggaataacattcccaggaagacgacagggaccattgctcacaatggctgctgctgagccaactgctgcttaacattaataaagcaattgcccccaccgttcacgagttaacatgttcacacacaccagaatctggctatgctctctcaacacctcaccctcttcccctcaggggaagaagaagggtattcacaaaatgaaatggaagagtctgccttgaatgtcccctgccctagagttctgtagcaataacatggtggatacagtggg

SEQ ID NO: 88786 - DNA, 312 bp, Homo sapiens
agaacccagagtaggcctggcacctcttgtgatgactgggtaagaatgagaagctaattcctgccagattggctctcaaaatgctaggctatgtgaggagtgtcatcctttgggaggctgacagcaaagtctggcttcactcactcagcccaagaatgatctgctgtcccaaaccttcaagaaacgacagggtctcagttgtgtctgagggaatgtctggccagcaggctttttcttttagatttattgtccactagccttgggtgaggccttctaggatagttgagagagcgagagagagagagagtgtga

SEQ ID NO: 88787 - DNA, 241 bp, Homo sapiens
ctgcaacctccatctcctgggctcaagcgattctcctgcttcagcctcccaagtagctggaattacaagtgtgctccaccacacccagctaatttttgtatttttagtagagatggggtttcaccatgttggccaggatggtctcaatctcttgacctcatgatccaccctccctggcctcccaaagggaaatcatattttaatcaaacatcccagataaatattacagttaggttaattt

SEQ ID NO: 88788 - DNA, 236 bp, Homo sapiens
aatagaggcagggtcccactatgttgcccaggctggtctgtaactactgggctcaagtgatcttcctccctcagcctcccaaaatgctgggattacaggcgtgagccacagcgctggccgacttcagattttcttaaggcattgtttggaaagcaagattcaaggaaactcctccttaggttgcagtgagctgagattgcaccactgcaccagcctgggccacagagcaagactcc

SEQ ID NO: 88789 - DNA, 799 bp, Homo sapiens
caacctggtgagaccctgagcagaggccccagccaacccgtacctgcagttctgacccatggaaaccgagatgatgaatttgggttgttttgacccacagaaaccaaggtgatgaatttgtggtgtttttaaacctccacaaagtagtgtgagaaaatacacagtagttgttttataccactacatttttaggtggtttgttatcacactggataattaaaacaccaatttaaatcttttctcagctaattttgtaccattagtgaagcataaacactccaaactatactactgtagtaaagaaaaccacctgcttctatgtgtgagaacacttgggtgaacatatcaataaaaagggtgaagaagggactctagctgtattgcattttgcatcatttatattcacttctatgactattttttgtaatactgtccaatgactgtgtcgtctctttttgcatgctttctattaaaaaataatagtgaaaattaaaaaaccccagtctgggcgcggtggctcatgcctgtaattccagcactttgggaggccgaggagggtggatcacctgaggtcaggagttcaagaccagcctggccaatgtggcaaaaccccgtctgtactaaaaatacaaaaattagccgagtgtgatggtgtgcgcctgtaatcccagctactccggaagctgagacaggagaattgcttgaatccaggaggtggagtttgcagtgagctgagatggcgccattgcactccagcctgggtgacagagcaagactcagtctaaataaataaataaat

SEQ ID NO: 88790 - DNA, 374 bp, Homo sapiens
gtcgaagaacgtacaggggtttccctaggtctcaaaatcagctgactgacgaagggcagtaaaaaatgtagagtgtcacatgtttttgagagccataaaattcaaagatcacagaacttttatcacatttatgcccacataagactgagtaatacatacaccaagattttccctgtgacaagctgggtgtgatgaacaaatctaggtccttcccaggctttatgttgggagtttgagaaaagcttaagcactgttttgcaaccaaaagcatgcaggtgttaaagttttaaatgtctctattgcttcttgccaaattttgcctggcatgaagggttggggatggagaggggacgaagaatagagggagggacagg

SEQ ID NO: 88791 - DNA, 485 bp, Homo sapiens
tttttcatggcaaaaagacagaaaagttcccttctgcagtctccagtgtcttctgacctcacagaaatgttttcatgcttttacctagcaggaccaccagaggctctgtcacacttgcagtccctggcccaacaccgaaatccttctggaatctgtgctctgggggctgtgccgggtagagagggcagtgggaggtaagagctcttcacccttcaccaccttctccacccagcatggccggcacactttggtctacggcacatctccaagtatagagtgggttttgaatgctgttatgtctcaccgtggggatgggaaggaatactctgttttggactatttggaggtacatgtgagtggattttattaccagagtaggaactgtttcaagttaatgtgtcttttatgttgcttttaagacaacttttgtgccgcttttatccattcttccttttatccacagaaatacaaatttctaattatag

SEQ ID NO: 88792 - DNA, 362 bp, Homo sapiens
gtaaagagggatggctgtacttgttattttaacttagtggaatttttagtgaagcttttgaatactacaggagttagattgttatatttggacttgtgtagcttcagaattttgacaatagctcattggccagaaaaggataactactgacatatagagggaacggatctgaactgattggttaaatgctgtacttctcatgatgactcttagcataaaggaaagaaattcatatttagcttaggaagatagataagaacaaagataaaagcaaatgtcaacttttacatttcttaagcaaaattagtagaggataaaaaataagcccttgtagtcatacacgttacttatcaaatagaggg

SEQ ID NO: 88793 - DNA, 428 bp, Homo sapiens
aatttgaaatattttctctttttttttcctttcaattatactctgtatgaaatggtttaatatatgtttccttggtttcaaccattggcattttttaaaagagaaaaaataccatggagtatttttaaaatgaactaacacatgtaatgaattacatggactttgcagacagataaaagggcaaaaaaatatgtccaatttcagggttttcagccctttcaacattgctttaatcatcctggtttgtcttttttcacaagggaatgctgtgttaatgactcagttttctatcttactctgttacactagaaatgaatcagaatgcctcattaggccagggtaaaccacaacatcagaatgtttatataacaatttattaaagcggaaatgcttgattgtggtttttaataaactgttgagtgtttaag

SEQ ID NO: 88794 - DNA, 421 bp, Homo sapiens
gcctactactactaaattaaaaaccgcgtcgacctctgtatgaaatggtttaatatatgtttccttggtttcaaccattggcattttttaaaagagaaaaaataccatggagtatttttaaaatgaactaacacatgtaatgaattacatggactttgcagacagataaaagggcaaaaaaatatgtccaatttcagggttttcagccctttcaacattgctttaatcatcctggtttgtcttttttcacaagggaatgctgtgttaatgactcagttttctatcttactctgttacactagaaatgaatcagaatgcctcattaggccagggtaaaccacaacatcagaatgtttatataacaatttattaaagcggaaatgcttgattgtggtttttaataaactgttgagtgtttaag

SEQ ID NO: 88795 - DNA, 1570 bp, Homo sapiens
aacctccacctcctgggttcaagtgattttcctgcctcagcctcccaagtagctggggttagaggcacatgccaccatgcctggctaatttttgtagttttagtagagatggggtttcaccatgttggccaggctggtctcaaactcctgacctcaagtgatccacccacctcggcctcccaaagtgctgggattacaggcgtgagccactgcgcctggctgagtacaatattaatgtagacaaaccatgaagtttattatttcatataagaacattacaggtttgttttttcttgcatgtctgtccacctaatgtttaagtagttctggtagctcttcctattctttattctatttgattccatttctgtgattcttttattaccactgatgttttgtgatagttaactatgataaatttaactgatcatgatttatcttctagagtatttaaataatgtatgagtgaccacccaattccaacattaaaagtgtaatctgggcccataatttatagtgaaattgtatcaaaacatagggaaactgtattactgtccattttgaaaatatgaaacttgagtattgaaaatattcaaacatggaatggcagtattctaatttcagttagttggttcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaagtaatgtcagaaaatgttaagcatgtctgtattaagaaaatataaggtttctaattgtcttattaatatggtaattcaagtgaattagaaatatttaactgcaatcttgaattataaagttgagatatatatatatatgtatcaagatctcaacttgatgtaaagtaaatgagcagttacctggcggatttttttttttaaataactgatttaatccataatcccataacaaacatagcttcacctcagtattttctttctttctttgttcaacagtgctccgataagggaatgctagaaaatagatgagaagtactgaaagacctttttttttaattgattagaaaagtaagtctctagggtctttgaatgctggaatttttttttttttttttgtctttcccatctgtggcagctaaaacaaaaatcactcaaaatattcaggtttacatgttagctctctctcatagggagctgccatacctcacagttcaaagtgtattctatagatcagtaacattatactgacatgtaattgcaatttactatgcagcaaaaatgattcaagaagaaaaataacctacagtgtctgtatacctttgtatacacaattgcttaagttactctgcttttaacatttgtacttggataaaatgcttatgtctgtataggaatgtcacagtgcaagatgctgctagcccaggcacaaagtattaaaattattttgtgaagattggtggttgtattaaaactgctgtgccattatacctccaaa

SEQ ID NO: 88796 - DNA, 1548 bp, Homo sapiens
  misc_feature (1464)..(1464): n is a, c, g, or t
  misc_feature (1486)..(1486): n is a, c, g, or t
aacctccacctcctgggttcaagtgattttcctgcctcagcctcccaagtagctggggttagaggcacatgccaccatgcctggctaatttttgtagttttagtagagatggggtttcaccatgttggccaggctggtctcaaactcctgacctcaagtgatccacccacctcggcctcccaaagtgctgggattacaggcgtgagccactgcgcctggctgagtacaatattaatgtagacaaaccatgaagtttattatttcatataagaacattacaggtttgttttttcttgcatgtctgtccacctaatgtttaagtagttctggtagctcttcctattctttattctatttgattccatttctgtgattcttttattaccactgatgttttgtgatagttaactatgataaatttaactgatcatgatttatcttctagagtatttaaataatgtatgagtgaccacccaattccaacattaaaagtgtaatctgggcccataatttatagtgaaattgtatcaaaacatagggaaactgtattactgtccattttgaaaatatgaaacttgagtattgaaaatattcaaacatggaatggcagtattctaatttcagttagttggttcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaagtaatgtcagaaaatgttaagcatgtctgtattaagaaaatataaggtttctaattgtcttattaatatggtaattcaagtgaattagaaatatttaactgcaatcttgaattataaagttgagatatatatatatatgtatcaagatctcaacttgatgtaaagtaaatgagcagttacctggcggatttttttttttaaataactgatttaatccataatcccataacaaacatagcttcacctcagtattttctttctttctttgttcaacagtgctccgataagggaatgctagaaaatagatgagaagtactgaaagacctttttttttaattgattagaaaagtaagtctctagggtctttgaatgctggaatttttttttttttttttgtctttcccatctgtggcagctaaaacaaaaatcactcaaaatattcaggtttacatgttagctctctctcatagggagctgccatacctcacagttcaaagtgtattctatagatcagtaacattatactgacatgtaattgcaatttactatgcagcaaaaatgattcaagaagaaaaataacctacagtgtctgtatacctttgtatacacaattgcttaagttactctgctttcaccaggggccgggaaaaaaacccggagcggggaganaaccccccaccaaagacccccncccccccgcccccaaagtattaaaattattttgtgaagatggggggggggattaaaaaaaaa

SEQ ID NO: 88797 - DNA, 787 bp, Homo sapiens
tgtgtttccgagacccagctaaggtgggcctttggtgggtgacctgtctctgacccgaggcagcagagttttgggggagggagaaacaagcaaggagcagggaggacaaggacacaagatccctttgctggtggtgacttactcacttcccccaccagagggcctgggactcccgaaactcccgtaactggaaagctccctggctcagctccactggggggtgaggagggcggctccctcagccccagcctagcggcctccaaccctgtgcctgagaacatgagcagcggtctaaagcatcccctagtcccatttcacttcacagaccgatttggttgcacagccctagaattcaacagacaacaaaaatgctgaaattccttagaatacgcagagggaggaggtgactcaccaaggtgctaaaacattttattaaaaatatatattgttaaattaagtctgctgtctggacaatgactgtttgttttgttttcttgtagtggagtttaaaagagactattattttactctgatatattattattaaaaaggcattttaactttgtacttgaaaactaaatgagcgatttcatgtgttttagctgaggcattgaagtagcgggtgcttacttatttgtgggaaatcatgtattcatactgaagaataaactccgtagctgatttggtaataacttttactgttacagacgatttcgctttgaccccggtggcagagcacttttactccacattccacgcagctaaatgcaggacttcccagactctt

SEQ ID NO: 88798 - DNA, 632 bp, Homo sapiens
  misc_feature (632)..(632): n is a, c, g, or t
gaatgtcagtgactgttgggtagtgaatatattttctgcttggatcccccaaatacccaacttttgctgtttctggtcactgtagggttagctcttggctggtcttttgggaggttttcccagtctgaagggcagtggaaacctctgctgattccctatgcagtggatgaatttttggctaaagttgtcttagttcctgccttatttactggtatagcaagttggtgtatgtggcataggtacaccttgctttatgtgaaagtcacaccagaagggcagtaaaggggaaacagtgctaactctagagttagcagacccaggctctggttctcacatggcctttgctccctcaggcttcctagtgttcccatgatcttttgctgaattccttcaaaatctagggatttgaaacaaacatgtcataagcacatgtattgtgtgggtcaggaatttggagaggccacagtggagtggcttgtctctggtccacaagcttggacctgggctggaaggactcaaagactgaagatgagttgatgctaagggctgggattatctgaaatgtctctccatgggcttggcttcatggccacctcagcacggtaggactttttaaaacattaaaaaaaaan

SEQ ID NO: 88799 - DNA, 586 bp, Homo sapiens
atatgatctcagatttttgcccacgaagtaaccataaaattaaaaacatttctactctcaattttggaaatttccaaacacacacaaaggttgagagaagaaaatgctgaacctctgtgtacccatcaaaccagctttaacaatgatcgactcaaggccaaccttgtttcatctgtacccccacacactcttatccccagtatcatcaaattattttaaagcacgtctcagacatcatattccattcataaatacttgagtatgtatctctaaaagataggaaccctttttttcttctaacaaaaccacagttccattaccatacctttaaaatgaatggtaattccctagtaagccatgaaatcattaaaaagaaataggatggcagtcagccttttatgctatgaatgtaatttatccctaaacaacaacaaaaacaaaaaaagtcaacacattcactttctaaaccaatatctcttttaataagacaactaataatgaatcaaatctaattttaaattaatttccctattcgatcattataatttcaatgaactgtagcatgacttcagcatttttgcttatg

SEQ ID NO: 88800 - DNA, 231 bp, Homo sapiens
agcaaagttgtccgagctgcgccgccactttgcctcctcttcccggctccgatcccgcctgtgccccagcccggcacggggacagtgcatttccgctcggagattcgcgtgacagaggcatctgcaacgacagcccgtttttatcccagaacttcgtgagaccccttttccctcccaccgcccgcgggcagtgtttcctcccgcagttgcagtgcaggggctggagaggta

SEQ ID NO: 88801 - DNA, 379 bp, Homo sapiens
gacatttaacttgttctcacagcttggctattgcaaataatgctgcaatgaatatctcataagtctcgtatatgtccatagaagatcatgaaaatggacatgtctctgggtattttgaattggtgggacaattttgcttaagggtaggcatagtgggtggctctacatttgagagttctaattcccattcctatatatatttcttttctttttatttatttatttttttgagatggggctctctgtcactcaggctggagtgcagtggcacaaacatggcttactgcagcctcaacctcctgggctcaagtgatcctcccatctcagcctcccaagaagctgggaccacaggcatgtgtcaccatgcctgactaatttt

SEQ ID NO: 88802 - DNA, 289 bp, Homo sapiens
ggaaccagcatttattgagagcctaccaaacagcagacacagttgaggcacttttcaatataccatcttaattaatcttcaaaggaaggaaacaaatgcaggagggtcatttttttccctatcaagttaagtagaacaagtaggtactgaatctgtatctgataaaaggtccatgttttttggctaaaacaatggtcaccacatcctttagtgagaatatttaattcaagcacgatatacttaatataaggttccactaattcctagttaatcattttactcatctttc

SEQ ID NO: 88803 - DNA, 539 bp, Homo sapiens
ttactcagtgctggaatctcttttttcatactatgtcacaagaaactgtccagcctctcctttttggcatcagggctccatttcttccccttcttggtgactataatggatatacccaagatagaatctgattgggtgtgagctgtggttgaccaggatcctgagagttgttcatcaaacatcccaaacatactttcatctcagggtctttgcgtttgctgttagctcagtctggaatgcctgttctgcaaaaacttgaatgtctccctttcccaccaccacatctgctcaagtgtcatcagacaggccttccctcataactgtctaaaacactcagcccattaatctttaactctttactctgatttgcatttctgcattagtactgataaatgccttattattcatatgtctgtttacttgtttatttgtgaccggcctccttctactatgtaagcatcataagatgagggactctgtatattttgtccattgttatacctccaagacctagaagagtacctgtcacactctataaa

SEQ ID NO: 88804 - DNA, 488 bp, Homo sapiens
gtctgtttttggactctatgttctattaaaattttaattaatttctgaatttgagaaaaatcagagccagtagtgtccgaattatgaatttacccctggttgtttttttactcttctcttgatgtacttctcacacactgcattctgttgcataaaaagaataacatggtgttgaatgacagatctaaagatggacatttgtctatgtggtaaatacgtggtagattctgggtgatttttcatatgcttcatataaaaaatgatcgtacataaaataacttttttggaaggaacataatctgagccattcagatacaacgaaatccagctcctctctatagcatcgctgtgggtgtagctaaaatatgagattttaagtttaaaaacaacttctgcatgttatttggaaatattttttactaatttcttacgcagcccaaaacttaatgggcaatttaaaatacgcatttagtgtcttagtattttac

SEQ ID NO: 88805 - DNA, 483 bp, Homo sapiens
aagtgcccagtcattagcaaaatggaaaaaaaggatcaccacaattcggaaggaaaggaaaagaaaaaaaaaagagtggaatgccatgtttcagtagaaaacacctttaaactgtttcataatatggaatagctaataagaatatgaattcagcaaaacataggttagaaaataaacagtagagtgaatgaaaagacacctgagctaagaaaacaaattgaagatcaaaagaaatcacaaggaacagaatggacaccccttaaaaacaagttattgccataggaaaaaagcttgaagtaatcacagtttatggaggtacctgaaaaagacaaaaattaaagcaataagtaaaatcttaaagacaggaagacaggactcatccattatgagaacagtagacattagtgtctgcatacaaatcctgtgtaattgaacgtttattttgagatgtatgtaagaacacgttttgaaatggaaataatg

SEQ ID NO: 88806 - DNA, 446 bp, Homo sapiens
gaaagtactttgtaacttataaagcattatgcagatgtagactccttttataatagttgtgtaagtatataagacaacctacattcttcatgagctagccataagttttagcaacttgcctttgaacccacggtagatttacaattttctgtagtattgagttgtgttcatttagaattttgtaatatttatattgaaaatcaaatttttgtacctacaaaaactacaaaaaatccccctagtttttatagtttctattaaaattatagctggtacatagggatgccagaaggactgtttaagaagctgaaaatagagaaatgaatttatcttctcatagttaggcagggcacagtagaaggatgcttaacattgcaagctgatgggaacagcaggttgatatagcttgtgataacacttctaaagaaaaagcaatgagccataga

SEQ ID NO: 88807 - DNA, 1134 bp, Homo sapiens
  misc_feature (17)..(17): n is a, c, g, or t
  misc_feature (68)..(68): n is a, c, g, or t
  misc_feature (74)..(74): n is a, c, g, or t
  misc_feature (83)..(83): n is a, c, g, or t
  misc_feature (116)..(116): n is a, c, g, or t
  misc_feature (120)..(120): n is a, c, g, or t
  misc_feature (129)..(129): n is a, c, g, or t
  misc_feature (136)..(136): n is a, c, g, or t
  misc_feature (140)..(140): n is a, c, g, or t
  misc_feature (146)..(146): n is a, c, g, or t
  misc_feature (162)..(162): n is a, c, g, or t
  misc_feature (171)..(171): n is a, c, g, or t
  misc_feature (200)..(200): n is a, c, g, or t
  misc_feature (210)..(210): n is a, c, g, or t
  misc_feature (236)..(236): n is a, c, g, or t
  misc_feature (249)..(249): n is a, c, g, or t
  misc_feature (254)..(254): n is a, c, g, or t
  misc_feature (262)..(262): n is a, c, g, or t
  misc_feature (267)..(267): n is a, c, g, or t
  misc_feature (280)..(280): n is a, c, g, or t
  misc_feature (284)..(284): n is a, c, g, or t
tgcgcttcactcggagncgagagcgtggagcctgtctacgacctttatctccaagttgctttcagccntgaggngtgacccanaggtatgcagcatccagagaaagcctttttagnaagntgaggagcngctgtgngcanagtggntcgaccagccagcccnccttgaagncttcccaggcccgctgaaaagacaccctnatgccttctncctggcccctaccgcgaaagcccggnaggccaactggcngctcntgaagcantattncctgctgaggacnatanagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactc

SEQ ID NO: 88808 - DNA, 1021 bp, Homo sapiens
tttaaacgtgcttcccacatgtcgtaatccttgtgaatcactattctttgctattgatttagaagttcttggttttgagtgaacattttttgttgccattgtacgtgattttttaggaaaaggttgttttgttaagatctgtacaaatcctccacgagcagccagattctgacgacggagatgtgttttgccaagataatgtgcacctcaacaagttttcttctgaacactgaaaaccacaaagatacccaaaaatgtggaagcgactctgaaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactc

SEQ ID NO: 88809 - DNA, 421 bp, Homo sapiens
tgccctcaagatgcttacctactagctggtaagacaaggcacacaaatgaacactaaaataaacactaagagagaattcctcctgtctgactgctaacagggacatcagcttttcttgccttcaaactgaaacactggttctttgtgggtctcaagcctttggattaaaactacatcaatggctctctgagttctcaggccttcagattcagactggatctacaccatgggctctcctgggtctccagcttgccaactcatcctacagatcttgaaacttaagtctccataacggcctgagccaattccttataataaatacatatctttatatccatttctccctctctctctctacacacacacacacacacacacacacacacacacacacacacacacacacacaccctttattgat

SEQ ID NO: 88810 - DNA, 118 bp, Homo sapiens
aatatatagagccgcacaccaaaaatagaagggtcaatttgattggatgataattgtgaagatcatattttaaaagaagtcaactaattaataaagttaacattgcacttataatttt

SEQ ID NO: 88811 - DNA, 439 bp, Homo sapiens
ataacttctctgggtctcaatttcttttgtggtaaattgtgatgttaatgtgattggtgtgatattaatgtgatttcttcagtggtaaaattgtgatattaatgtctacctgcttcatagacttaccatgttgattaaatgagataaagtatataaagtgcttagcatagtgcttgcccataatgagcactcagtaaacgatagctgttcatattatcgtcatcatccctgtccctgaaacttcagtacaagtgatgtggtaaaaactagaatagtcaaccaagaggctgattgctggtaaagtaaacctaaccataggttctgtagctaccacgtacaagctatctaactttacctactgtcttcacccatttctattaaatcacctcaacttccctggccactgtacaaaggcccctttcctcatttgatatctacc

SEQ ID NO: 88812 - DNA, 339 bp, Homo sapiens
ggctgtcactgtttaaaaaattataatgtttctcaaagaaattccaaagaacatggaacaggaagaatccagaactgctgcccatcataaaatttttccatctgcaatttgtgtctacagtgtgccagttattgatgaggagacaaggtttcgccatgttgcccaggctgctctcgaactcctggactcaagtgatccttctgcctcggcctccccaagacctgggattgcaggctgaatcctattccaccgtgtggatgggccccagcttcttacccaccacccatcagcggacactcgggttgctcccaccgttgggccatcgtgaacagcgctgca

SEQ ID NO: 88813 - DNA, 412 bp, Homo sapiens
tctattttcttacattaattaatttaaattatttagaaaatgggcccaacattagctttctctgtggttctgggtaacaatttctcacaggccctagttgttaccttctccaaactgttgatttgtaatttgcttattttgagaaagccagttgtgtattctgagcagcctcttcctggctgaattgaaggtaatgagagagactggatgtctgcctacccagttcctccccgcgtgctttgcttctgcattcactgctgccactggagaatatttaataccaaagtcaaaataagtgtttaggaggctttcagtggtggtttaaaataattaccatgggggctttggtaaaagcctttatccagaaaactctttaaattatataattatatcccttatcccactcttcctt

SEQ ID NO: 88814 - DNA, 396 bp, Homo sapiens
ttatatgtttagggtattaagcccttatcagatatatgttttgcaaatatattctcccatttcgtagattatctctgcactctgttgtttctcagtatgattctttttttctttgagacagggtctcactctgtcacccagccgctggagtacagttatatgatcactgctcgctacagccttgacatcctgggctcaagtgatcttcccacttcagcctcccaagtagctgggactacaggcgcatgccaccacacttggctaaggttttctttcttttgttttctgtagagatggggtctccctatgtggcccaggctgttcttaaactcctgggttcaagcagtcctcgcaatgtattgggattacaggcaagagccactgcacccagcctct

SEQ ID NO: 88815 - DNA, 316 bp, Homo sapiens
aaattacaggccaatatccctgatgaacatagatgcagaaacccccaacaaaataccagcaaactgaattcaacaacaaatttaaaagatcattttcccatgatcacatggggagataaccttttgcatttaaggatggttaaacatacataaatcaataaatttgatagatcacattaaagtgaacatcaaaaactacatgtctcaatacttccagaaaaagaattgacaatatttaacaaccttttttttttttttttttttcggagacagagtcttgctctgtcacccaggttggagtgtggtggcactatct

SEQ ID NO: 88816 - DNA, 421 bp, Homo sapiens
gtaattttgtgagcctgaacttgatttaaaaaactaattgactttgaaggctagtttaatttagctaagttttaagatctgagagtaattcctaaaaatgacaagatattaatagtttaaagttaagtattttagaattatttcagaatgaactatagatagtaaattaagattaagaaagcagtttcttaatatcctaatgttatgttctgatttttggattcttaattattttctgccttattgtgaattgctttagaaaaggttagtagaattaacatgaccatttaagcagtttcagcttatttccttttttaaagaaatgtagtagtctttttaaaactaaggctgagttgtttttctaaatagactaaaaattttatagaaggccaaataaaaatatattaaacatttcaaagaa

SEQ ID NO: 88817 - DNA, 561 bp, Homo sapiens
ggggagggtggtaggtagttcctatttgttttaaaaagtaatgaagataaactgctgagcatcaaattaacgaaagactgaaaaaaagcaaattgcaaactattgagaagcagagggtggctcaacgtttttgaaaaaactgattctgacaatcagtgaaataattatggacatcttcgcaaaagatgtttccaaattttttggccagtgactttttacatgtctctgaaaccaaacattaaaaacaaacaaacaaaaaatcccttcgagatgggtaaaatatgagagaatcaagttgaacagaggctaatcctacgttgcttgaaagataaaaactgcagctgatacacagacttgtaaaacctagcatgtctcaatagaaaggctgcaaggacgttctgctatactaaagacaatgcacttccaacactttttaaaggcaaagatccagtaagtgacaggacatgagacagagccatctccaccacttgtacactagtgcaaaccactgtcacctctgactactgcaattgcctcctaacccatttccctgcttctact

SEQ ID NO: 88818 - DNA, 302 bp, Homo sapiens
aagtccttatcatgtaactttaagtaaattacatgcctttcaaaatatggttaggcatgggacgcttttcatggcttaaaaagatggaacatgaccaggtgcagtggctcatgcctgtaatcccaacactttgggaggccgaggcaggtggatcacctgaggtcaggagtttgagaccagcctggccaacatggtgaaaccccgtctctactaaaaatacaaaaatagccgggcacggtggcgggcatctgtagtcccagctactcaggaggctgaggcaggagaatcgcttcaacccggga

SEQ ID NO: 88819 - DNA, 504 bp, Homo sapiens
  misc_feature (395)..(395): n is a, c, g, or t
  misc_feature (462)..(462): n is a, c, g, or t
catgatcccacgaagtattagctccattttacagatatgtaaacttttctaatttaggtttagataaatgaagtgatttttatccaatgttgcatggcatagtcaagattcaattagatctaactccgatctattctcttcccctatttgaatgcgcttctcagttgagatagaaaaaaatgctaaggaaataaacctactattttggatggactaataaagaagagaagaatttatggcatgaataatgaaaagaagttatgcttgaagaattcagctattcattatattaccatttgaacttaaacccaagtatttacctataaaatgtgaataatgggaataatgtatgaacccttacaggagtgtcaacatggctgagtagtaacacttancaaccacagtgtttattattacaaaacaatatggtaacattacatgttacaaaacagaagataaagncactcaatcccacaatcttaatacaattactttccaggtctg

SEQ ID NO: 88820 - DNA, 238 bp, Homo sapiens
caggagctctatgctgctgctagaagctttgattgtgacttgggtaccaaaggcaggccaagttaaagcaattgaaaaaaaatcaaaagacagtgaatgattttgggggtcagaagaagggagtcagggagggacacattcactgatagaaggtctctatcacaattcttcaactctgcagttgtaacacaaacacagtcatagctaatgtgtatatgattgggcgtggctgtgttcc

SEQ ID NO: 88821 - DNA, 285 bp, Homo sapiens
agtcacacctgctgacaacagcctcagctcttaaacactgaaaaatggcaaatacaaacagctaaaacgtttttgaaagaagggaggtctgctcagtttttgcttctgggagaatgaaggctgagggtaagccaatagagcatttctattcaagatctctctgctgaacacagttctcagtgcaccggaagggtcatgctcagtgctcaggaccatgttctttttttttcttttcgagatagtctcactctgttgcccaggctggagtgcagtggcatgatctca

SEQ ID NO: 88822 - DNA, 238 bp, Homo sapiens
atcctgaaaggccttgtatgttacaaagaaaagtttggactttctcctgggattttagaaagatatagaagggttttaaggatacaatttcatttggaattggaatctcgtcttggctgcccagtggagatgggaagaataagatgcagggtgagaaggttgttggtggagagcatgctacatgctagagagatagtatcttgtcaggaattttttagttgctagtgacagaaactta

SEQ ID NO: 88823 - DNA, 880 bp, Homo sapiens
cccggctcgccgccgtgccgcagtcacgaggctctccgaacgcctttcactgtgtttctgtttacattcgcgtctgcaagacccggcggcgcgaccgaggcccgaacagatggggtcttgctgtgttgcccaggctgggcttgaactcctggactcagacgatcctcccgcctcggcctcccaaagtgctggaattacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttttgcagcaatagataactaattcactaggtaaaggttatatccattgtaatctttcaacttttctgtagatttgcagttttatgtgctgacaggtgaacacactgctgttggcaccatggccactgcatactacgtgctgtcatgctaacatttgatgctgcagcagtaagttatttctcaattgattctgagtctctggttcactagcaggatcatgtgcccaagctccagcttccaaggtgtgaggccagaaagtacctgaccctctcagcttccacagtgggaattgtggccctgtctctcaaatagggaggtattcagacactgagtagatg

SEQ ID NO: 88824 - DNA, 789 bp, Homo sapiens
cccggctcgccgccgtgccgcagtcacgaggctctccgaacgcctttcactgtgtttctgtttacattcgcgtctgcaagacccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttttgcagcaatagataactaattcactaggtaaaggttatatccattgtaatctttcaacttttctgtagatttgcagttttatgtgctgacaggtgaacacactgctgttggcaccatggccactgcatactacgtgctgtcatgctaacatttgatgctgcagcagtaagttatttctcaattgattctgagtctctggttcactagcaggatcatgtgcccaagctccagcttccaaggtgtgaggccagaaagtacctgaccctctcagcttccacagtgggaattgtggccctgtctctcaaatagggaggtattcagacactgagtagatg

SEQ ID NO: 88825 - DNA, 719 bp, Homo sapiens
aagtggaaacaacccaaatacccatcaactgatgaatggatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttttgcagcaatagataactaattcactaggtaaaggttatatccattgtaatctttcaacttttctgtagatttgcagttttatgtgctgacaggtgaacacactgctgttggcaccatggccactgcatactacgtgctgtcatgctaacatttgatgctgcagcagtaagttatttctcaattgattctgagtctctggttcactagcaggatcatgtgcccaagctccagcttccaaggtgtgaggccagaaagtacctgaccctctcagcttccacagtgggaattgtggccctgtctctcaaatagggaggtattcagacactgagtagatg

SEQ ID NO: 88826 - DNA, 467 bp, Homo sapiens
cccggctcgccgccgtgccgcagtcacgaggctctccgaacgcctttcactgtgtttctgtttacattcgcgtctgcaagacccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcagccagcaggttctcttcaacaccccagccctggagagccgcagattggacaacgggcagactttgttgaacagatgaacaactgtggctaaatctgtttt

SEQ ID NO: 88827 - DNA, 392 bp, Homo sapiens
ggaattaggggatgggtagggtggggtgagactaggagcacagagcacaagccagaacatcccacagtcctgctctaggaggatggaaagagcaggactttggaggcagaaagacacgtgtttgatttccagctccacaatcacaagctatgtatgacccttgtgcaaatcatctaagctctctgagacctgatttttgcatctgtaaactgggttataatgagacctacctcactgggatagctggaaagattagaggagatggtgtgtgtgaaatttcaaacagtgtctggcacattgtagggatgcccctttcacagcaacagggataaggagaggaaggagggtgaaggggagagttggctctgtcactcattcggtgactttgggtc

SEQ ID NO: 88828 - DNA, 479 bp, Homo sapiens
ctgggagcaggggactggtggtaagtggcagcttttagagatgccatgcattaagtacacaaggctttaaatgggccacccgcagagaaggtgtattaggcagtgagggggaggaggcctgcaagctatcccgctgtgccacgtgaaaggctggtagttcctaattactttctgagagttttcatgaacacctcacatatgccattttgcttcaggaacacaaagcaattagaaataaggtttcagactttatgactctaactagctgcagcggagagcatttgcctgcacacacacatttggctcaaatgtgaatgtaaaaggcgattaaggaaatgtgcagttcggtgctgcaagcctctcaggggacaaggaaaatgacaaacgctcatttcagggctctgggtggcaatcactacccacttccacagtgtcattcagatatcaccatgacaaccaccaaaaggcttccttcctct

SEQ ID NO: 88829 - DNA, 218 bp, Homo sapiens
tgcacactacagagcatggtgtcaggggccaaatggagggaaggaccacttctggctgcagcatccaggaggcactctgcagtccttccttctaggttctcggcatatgctccatgcctgtgtgactgctcagcctgccctgttccggacacttgctcatcttccttatctttctctgtagcatgagaaatgtaagtttgaaaggacaaaattctgcc

SEQ ID NO: 88830 - DNA, 989 bp, Homo sapiens
agcggtatgtgacatatgaattaagtggtcaaatgtaaaactaatggggacaccaagcctcaggaagaacatcccatgtttctgtttaattctcttatgtgttatactaccttccctttctctttcttatacacatagattttccttaattgcagcccaagaggacactgccccattttgttttgttcttttgtcattgggacttaaagtgggtgcctcaagtctttggtaacagttttaacagaacactgacaatgactggatatcagtcagtgttgatctccttcccaagctactgtctgaacactaagatcctttttttttcttttaatgaaaggtaaaatacaattctgctctgtgatttatacttctaccagatttgttttattgacttttcattagtctctcaaagatgatacactgtttttctttgttaaatgtttgggccagtcacggtggctcacgcctgcaatcccagcgctttgggaggccaaggccagcggatggcttgaggtcatgagttcgagaccagcctcatagcggaactctgtgtctactaaaaatacaaaaattagctgggcctcatagtgcagacctgtaatcccagctactcgggaggctgaagcaggaggatcacttgaacctgggagatggaggtctcagtgagctgagattgcgtcactgcactccagcctgggcaacaaaatgagactccatcactgtcaaaaaaaaaaaaaaaagtttgtaggaggaatgattgtttcctattgttggaaaaaaagccaaacggagtgagaatttagagcatgaactttgaatgagtcctatattgtagtttcagccttaccccttacctgtatggccttaggcaagtcactctacctgtccaaatctgtttcatcatctgtaaagtaggggtggtagtaatagttaactctctctcaaatgtgataaaaatattaagtgcttagagcagggttcaccctact

SEQ ID NO: 88831 - DNA, 254 bp, Homo sapiens
gatctgaaatgagaggttttggtttaccctatctatggtatgtcttaaaaatcaacgaagatgtccttgtcttttttgaatttgccgagtgtgttgcagttccacagctcactgttaggtggcacataccccaaactgaaaacctgacctcgtagggcatgagtcaaaagacaggtaggcacaggacagggcagtggtgacactacagctttcagggttcccagcctgtcaagaatgagcatgtcttagcaggg

SEQ ID NO: 88832 - DNA, 450 bp, Homo sapiens
tattttctttattgctagttccttgcaggatgtctcacagtattaccctgggtaccaacaataacagtgtaggttgaactattggtgtctaataattataagtttcaaaatggcacattggaggtttcgatcagcctcgtcagactatagagtcttgcagacacaaaaggttgtggaaatgattgtggatggtactgcagctgcagaaaactgcaccctaattctgggactctttgtagatactcagtaaccctcttgtttagtaaatagctgctcctagacatagggagcaggaaggagggagagtgggaaggaaagaaggtgggcccttaatgatttgggaaggagattcatagggaattgtagtggaaatatgggcctttgcaaaaataagtctaatgttgttcggggatggctttttagaggaggtgagtgtaaagcaagttttaa

SEQ ID NO: 88833 - DNA, 405 bp, Homo sapiens
cagatcgtgtccttaacgccaggtgtgtggtcgaattgcctcaggagtctggatgtccacagggtcctttcaacaccatcccaaactgacctcaggctctgtctgacttctgccctctcaacagcggcactcctcagtcctccccctcacaccctgtgctttaataacagtgagttatactttatttattatgtgttcagagcagcagtgggtaagagcacgatctctcaagtctggtccaaaactcccctctgcccatgtactaggcaataactaggcaggttatttatgcccataaactaggcaagttatttgcccataactaggcaagttatttatgttgtgtctcattttctccttctgtaaaacggggcttattatagtgcctgcttcgtagattgtttt

SEQ ID NO: 88834 - DNA, 666 bp, Homo sapiens
gtcacacacttaataacacgtgaaactatttatgtgaagtccttgttttattttaaaattctctttgtgtatttggaatcaaagccagcacattgtaacctgtgcttgtacgcaaaagaattagatttctttgtttttgttttattttttaaattgttgtaaaaattattataggccagctacatctagtagtaggtttggggtacagattgggggttgtgccatactgtttttaaagttcatgatcatctggaatgatacttagtgtatatatattttgtaaagttttaattcagcaaattttttgaaattgctgctgttttaaattataaaacctttatatttctgctttgtagaaattatatgttttgtagtattcattgattttctttcactgtacttaaatttagtgttagtactttaaaatttttaatttaccagtctttaaagcaacatccagaaaaaaaaaagtcttttcccatttaaaataggctcagccagttcaatgtcgccttgttatcagagaaatattagttcaatactgaaagaaaaatattatacctcttggtatctagaaaagcttgttcatccattataaatatatctttagccacagcaaaccacacttaacctatctataataaaaatgtgctttaaataaaaatg

SEQ ID NO: 88835 - DNA, 1009 bp, Homo sapiens
tatatcgagtctactgtatcattccacggcctgtgcttcttcttaattctggtactcacttaggggtaaggaggggcgatgcctggttgtggcgtcaggccccatggggccccttgcacagctggattcttgagttctgtttgccaagtgggcacaagctgcccctggatgcctggggttgaggcatcatctcatccatgttagccgggaaagaaatcaaatccccagcctcagcctgttaagctcaggcctttcaagcagggccactgagtggtagcttcgaaatgagtcactgtggtgggtggtcatcgtgcccctcacagggacttgaccgtcatcctgcagcagaggccagttcagggagccccacacctcaccaagacactagccattgcctgcgtgtcctggaaggtgagatgtagtcctcaggtgaggtgacccaaagcagatggggtgaggggccgatgagcagccgggcccagcggggcttcctggatatcctgctcccaaggccaagcagcagagagaggttcaagtgaggccactttgctttgggtccagctacacccagagcctcagcctagaaagctgtcctccagcaggctgggggtgttctaatatgtgtccgtttgcatttccggtgtgtgtgtgtgtgtgtgtgtgtgtgtgtgtgtgtgtgtgtgtgtgtactgtatcttcttagggacttgagtgtagtcacgtgactttgcgccttgcagcgcctccgccgtactcgtgtgtgtatgtgtctgtgtgtttccgtgctacccaagcgtctgtttctctccgtgtgcctgggagatcaggtctcaggcatggagctgcatgcctttgcatctgctgctccccagagtctctgcttgcatgtgagggctggtggtatgaggcagacagcagagattgtgtgtgattgtgttgaaccgccaagagaaggcacctctgaactctgtccccacacccatgggtgaaaaccagacacctctgagac

SEQ ID NO: 88836 - DNA, 650 bp, Homo sapiens
agagagagagagagagagagagagagagagagagagagagagagagagagaggtgagatgtagtcctcaggtgaggtgacccaaagcagatggggtgaggggccgatgagcagccgggcccagcggggcttcctggatatcctgctcccaaggccaagcagcagagagaggttcaagtgaggccactttgctttgggtccagctacacccagagcctcagcctagaaagctgtcctccagcaggctgggggtgttctaatatgtgtccgtttgcatttccggtgtgtgtgtgtgtgtgtgtgtgtgtgtgtgtgtgtgtgtgtgtgtgtactgtatcttcttagggacttgagtgtagtcacgtgactttgcgccttgcagcgcctccgccgtactcgtgtgtgtatgtgtctgtgtgtttccgtgctacccaagcgtctgtttctctccgtgtgcctgggagatcaggtctcaggcatggagctgcatgcctttgcatctgctgctccccagagtctctgcttgcatgtgagggctggtggtatgaggcagacagcagagattgtgtgtgattgtgttgaaccgccaagagaaggcacctctgaactctgtccccacacccatgggtgaaaaccagacacctctgagac

SEQ ID NO: 88837 - DNA, 696 bp, Homo sapiens
caaaaaacaaccattgaatgttgttgataacattcaaaaggccaaatgaaaactcaaatggccaaatattgataattattgaagtgggtgaatatgtacacagttatcttaaactgatctacttttttgtatgcttaaacatttccataataaaatgataaatttaaaaatttaatacataaaacacagaatccaaaagaaacaatttcaaagaatctcacagagcagcagaaagctttggggccagcaaacagaaagatggttctccttcaggtaatcagtatccagaactgggatactgatggcagatgggagtgttattatttaacacatggactttgaacaactgctgacctaggggtttcaatcactaaaagggctcctctttcagaaaatgccagaaattgcccagcatgaaacagaacagacagtacaaacattctgcaacacacagaagaggaccagcagaatctggacttttgaaaaagaaaaaatctaactgaataacaacatcaaagtctcctgggcaaaggggttaaagatttacaacatttctttagaggaaaaaaataactggttgaatttacagagcatctgctatgtgccaaacatttaatgagcactttaaaagcatgataaaaattaaaaaaaaaacttgttaagcatgaaataaattacctataatgcaaaatcaat

SEQ ID NO: 88838 - DNA, 1673 bp, Homo sapiens
  misc_feature (1)..(1): n is a, c, g, or t
  misc_feature (5)..(5): n is a, c, g, or t
  misc_feature (8)..(10): n is a, c, g, or t
  misc_feature (13)..(16): n is a, c, g, or t
  misc_feature (18)..(20): n is a, c, g, or t
  misc_feature (23)..(25): n is a, c, g, or t
  misc_feature (27)..(27): n is a, c, g, or t
  misc_feature (31)..(31): n is a, c, g, or t
nctcntgnnnatnnnngnnntcnnnanatcnaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacgtgagtatgtttccttcccttcctttctcctgcttgcatggctgaccaattactctgccctcactaatcattccatctgagaaatgtatttcttattaccaaaaataatctaatatttaatactcatgccagtagcttttctggggtatgatttaagaggttactgattttcctaagaaagtatgatttcagaatgtcattattattagtagtaatttatcaacaaaagttgtggtctcactgcctttattatggtaatttactcaatcttttctctttagaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagatttttttttcctgtggctcttttcaattatgagatcagttcattattttattcagacttttttttgagagaaatgtaagatgaataaaaattcaaataaaatgataactaag

SEQ ID NO: 88839 - DNA, 1174 bp, Homo sapiens
accgttatgaccagtaaatttgttttcaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacgtgagtatgtttccttcccttcctttctcctgcttgcatggctgaccaattactctgccctcactaatcattccatctgagaaatgtatttcttattaccaaaaataatctaatatttaatactcatgccagtagcttttctggggtatgatttaagaggttactgattttcctaagaaagtatgatttcagaatgtcattattattagtagtaatttatcaacaaaagttgtggtctcactgcctttattatggtaatttactcaatcttttctctttagaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagatttttttttcctgtggctcttttcaattatgagatcagttcattattttattcagacttttttttgagagaaatgtaagatgaataaaaattcaaataaaatgataactaag

SEQ ID NO: 88840 - DNA, 2166 bp, Homo sapiens
aattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtaaaaaaaaaaaaaaaaaaaaaaaactcactagttctctcctcgtgccgaattcggcacgagaggaaacgctgggttcaacttgaagcccttccacagacattaagtcggtgtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacgtgagtatgtttccttcccttcctttctcctgcttgcatggctgaccaattactctgccctcactaatcattccatctgagaaatgtatttcttattaccaaaaataatctaatatttaatactcatgccagtagcttttctggggtatgatttaagaggttactgattttcctaagaaagtatgatttcagaatgtcattattattagtagtaatttatcaacaaaagttgtggtctcactgcctttattatggtaatttactcaatcttttctctttagaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagatttttttttcctgtggctcttttcaattatgagatcagttcattattttattcagacttttttttgagagaaatgtaagatgaataaaaattcaaataaaatgataactaag

SEQ ID NO: 88841 - DNA, 1747 bp, Homo sapiens
gtcggggccagagcgcaggtgtacctggcggccgtgctggagcacctgaccgccgagatcctggagctggctggcaacccggcccgcgacaagaagacccgcatcatcctgcgccacctgtagctggccattcgcaacggcgaggagcttaacaagctgctgggcgaagtcaccatcgcgcagggcggtgtcctgcccaacattcagggcgtgcttctgccccagaagaccaagagccaccacaaggccaagggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagatttttttttcctgtggctcttttcaattatgagatcagttcattattttattcagacttttttttgagagaaatgtaagatgaataaaaattcaaataaaatgataactaag

SEQ ID NO: 88842 - DNA, 1782 bp, Homo sapiens
  misc_feature (1)..(1): n is a, c, g, or t
  misc_feature (5)..(5): n is a, c, g, or t
  misc_feature (8)..(10): n is a, c, g, or t
  misc_feature (13)..(16): n is a, c, g, or t
  misc_feature (18)..(20): n is a, c, g, or t
  misc_feature (23)..(25): n is a, c, g, or t
  misc_feature (27)..(27): n is a, c, g, or t
  misc_feature (31)..(31): n is a, c, g, or t
nctcntgnnnatnnnngnnntcnnnanatcnaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacgtgagtatgtttccttcccttcctttctcctgcttgcatggctgaccaattactctgccctcactaatcattccatctgagaaatgtatttcttattaccaaaaataatctaatatttaatactcatgccagtagcttttctggggtatgatttaagaggttactgattttcctaagaaagtatgatttcagaatgtcattattattagtagtaatttatcaacaaaagttgtggtctcactgcctttattatggtaatttactcaatcttttctctttagaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagaaaatgccagaaattgcccagcatgaaacagaacagacagtacaaacattctgcaacacacagaagaggaccagcagaatctggacttttgaaaaagaaaaaatctaactgaataacaacatcaaagtctcctgggcaaaggggttaaagatttacaacatttctttagaggaaaaaaataactggttgaatttacagagcatctgctatgtgccaaacatttaatgagcactttaaaagcatgataaaaattaaaaaaaaaacttgttaagcatgaaataaattacctataatgcaaaatcaat

SEQ ID NO: 88843 - DNA, 2220 bp, Homo sapiens
aattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtaaaaaaaaaaaaaaaaaaaaaaaactcactagttctctcctcgtgccgaattcggcacgagaggaaacgctgggttcaacttgaagcccttccacagacattaagtcggtgtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacgtgagtatgtttccttcccttcctttctcctgcttgcatggctgaccaattactctgccctcactaatcattccatctgagaaatgtatttcttattaccaaaaataatctaatatttaatactcatgccagtagcttttctggggtatgatttaagaggttactgattttcctaagaaagtatgatttcagaatgtcattattattagtagtaatttatcaacaaaagttgtggtctcactgcctttattatggtaatttactcaatcttttctctttagaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagatttttttttcctgtggctcttttcaattatgagatcagttcattattttattcagacttttttttgagagaaatgtaagatgaataaaaattcaaataaaatgataactaag

SEQ ID NO: 88844 - DNA, 299 bp, Homo sapiens
gttttatgggctgggcttggaaatggcctatgtcacctcaccttcattcagtcttctggtcattcctagctgcaaaggagactggggaatttaacccacctctatgcctggaaggaagaagtaacagatttggtgagcatttggccagtccaccagagtgagtcacttggtttggctaaaatgagctctttctctgtggaaatgtattgtctttccaaaaactcatagggattttccagactaataccccatttctctagctgtccagggaaagacaagaaagactttgaaatctaaca

SEQ ID NO: 88845 - DNA, 737 bp, Homo sapiens
aagcagggtatcaacgcagagtgcccattacggccgggggacctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88846 - DNA, 845 bp, Homo sapiens
  misc_feature (3)..(3): n is a, c, g, or t
tgnattcggccattatggccgggggagctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaatcagtatacatctcaaaaaaaaaaaaaaaaaaaaaaaaatgttggccgcttggcccaataatttaaattgacaagttttgatggcggcgaattaggctaattggcatttgcctaaggggggcgatattgggcccggttagggg

SEQ ID NO: 88847 - DNA, 774 bp, Homo sapiens
  misc_feature (757)..(757): n is a, c, g, or t
  misc_feature (766)..(766): n is a, c, g, or t
gcgaattgggtaacgggccccccctcagtgtcgcgggtatctataagcttgaaatcgaattccgctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaacaagtaacctttcgtgnataaaagtnggttaaaa

SEQ ID NO: 88848 - DNA, 662 bp, Homo sapiens
aagcagggtatcaacgcagagtgcccattacggccgggggacctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagcta

SEQ ID NO: 88849 - DNA, 492 bp, Homo sapiens
  misc_feature (45)..(45): n is a, c, g, or t
atgaggtatattggtattttgatttagcccgtcctttttgttccntcacctactattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88850 - DNA, 495 bp, Homo sapiens
  misc_feature (43)..(43): n is a, c, g, or t
ttttttatttctataatattgataattaatatctccctctccncctttgaacacctaattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88851 - DNA, 1386 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagctt

SEQ ID NO: 88852 - DNA, 1070 bp, Homo sapiens
  misc_feature (791)..(791): n is a, c, g, or t
  misc_feature (798)..(798): n is a, c, g, or t
  misc_feature (811)..(811): n is a, c, g, or t
  misc_feature (823)..(823): n is a, c, g, or t
  misc_feature (833)..(833): n is a, c, g, or t
  misc_feature (841)..(842): n is a, c, g, or t
  misc_feature (876)..(876): n is a, c, g, or t
  misc_feature (882)..(883): n is a, c, g, or t
  misc_feature (886)..(886): n is a, c, g, or t
  misc_feature (903)..(903): n is a, c, g, or t
  misc_feature (928)..(928): n is a, c, g, or t
  misc_feature (945)..(945): n is a, c, g, or t
  misc_feature (950)..(950): n is a, c, g, or t
  misc_feature (958)..(958): n is a, c, g, or t
  misc_feature (961)..(961): n is a, c, g, or t
  misc_feature (987)..(987): n is a, c, g, or t
  misc_feature (1010)..(1010): n is a, c, g, or t
  misc_feature (1017)..(1017): n is a, c, g, or t
  misc_feature (1026)..(1026): n is a, c, g, or t
  misc_feature (1033)..(1033): n is a, c, g, or t
  misc_feature (1037)..(1037): n is a, c, g, or t
  misc_feature (1042)..(1043): n is a, c, g, or t
  misc_feature (1047)..(1047): n is a, c, g, or t
  misc_feature (1049)..(1049): n is a, c, g, or t
  misc_feature (1052)..(1053): n is a, c, g, or t
  misc_feature (1058)..(1058): n is a, c, g, or t
  misc_feature (1064)..(1064): n is a, c, g, or t
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaaaaaaaaaaaaaaaaaaaaaaaaaactcnagggggncccgtaccaattngcctatatgagncgatacaatnactggcgnngtttacacgtctgactggaaaaccctgcgtaccnactaanngcntgagaatccctttgcangtgcgtatacaaaagcccgaccgangcctttcaacagtgcanctgantgcaatgnaantgaacgtaatattgtaaatccgtaantttgtaatactatttttaccatngcgaatngaaaacctntaataangatnccgtnnggtngngtnncattngaaaancccttt

SEQ ID NO: 88853 - DNA, 1331 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtattggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagctt

SEQ ID NO: 88854 - DNA, 792 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaaagtaaaaataactatcacctaatgttctgtcggccgcctcgccc

SEQ ID NO: 88855 - DNA, 1064 bp, Homo sapiens
  misc_feature (785)..(785): n is a, c, g, or t
  misc_feature (792)..(792): n is a, c, g, or t
  misc_feature (805)..(805): n is a, c, g, or t
  misc_feature (817)..(817): n is a, c, g, or t
  misc_feature (827)..(827): n is a, c, g, or t
  misc_feature (835)..(836): n is a, c, g, or t
  misc_feature (870)..(870): n is a, c, g, or t
  misc_feature (876)..(877): n is a, c, g, or t
  misc_feature (880)..(880): n is a, c, g, or t
  misc_feature (897)..(897): n is a, c, g, or t
  misc_feature (922)..(922): n is a, c, g, or t
  misc_feature (939)..(939): n is a, c, g, or t
  misc_feature (944)..(944): n is a, c, g, or t
  misc_feature (952)..(952): n is a, c, g, or t
  misc_feature (955)..(955): n is a, c, g, or t
  misc_feature (981)..(981): n is a, c, g, or t
  misc_feature (1004)..(1004): n is a, c, g, or t
  misc_feature (1011)..(1011): n is a, c, g, or t
  misc_feature (1020)..(1020): n is a, c, g, or t
  misc_feature (1027)..(1027): n is a, c, g, or t
  misc_feature (1031)..(1031): n is a, c, g, or t
  misc_feature (1036)..(1037): n is a, c, g, or t
  misc_feature (1041)..(1041): n is a, c, g, or t
  misc_feature (1043)..(1043): n is a, c, g, or t
  misc_feature (1046)..(1047): n is a, c, g, or t
  misc_feature (1052)..(1052): n is a, c, g, or t
  misc_feature (1058)..(1058): n is a, c, g, or t
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaatcagtatacatctcaaaaaaaaaaaaaaaaaaaaaaaactcnagggggncccgtaccaattngcctatatgagncgatacaatnactggcgnngtttacacgtctgactggaaaaccctgcgtaccnactaanngcntgagaatccctttgcangtgcgtatacaaaagcccgaccgangcctttcaacagtgcanctgantgcaatgnaantgaacgtaatattgtaaatccgtaantttgtaatactatttttaccatngcgaatngaaaacctntaataangatnccgtnnggtngngtnncattngaaaancccttt

SEQ ID NO: 88856 - DNA, 737 bp, Homo sapiens
ctctgcagagcttccgctgcttcaaaacggcgtgcaggagtcagagacattacatcaggaagatactgcagagatattctactccatctcattcattgtacaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88857 - DNA, 821 bp, Homo sapiens
ctctgcagagcttccgctgcttcaaaacggcgtgcaggagtcagagacattacatcaggaagatactgcagagatattctactccatctcattcattgtacagattctaaactccctgaaggagacaaattaccagtggacaagaacacagcctctggagtccaataggcctggtgcattcattagggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88858 - DNA, 854 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaatattgagcaaaaaaaaggaaaaaaaaaaaaatttgtggcgcttggccgaagaaagtttaaaccatcgtggtggggggggccaggggagggaattggctaggggccaaggaactggcgtggggggttcacaaaaaagccgggccgggtttgacacgagggtgggtgggctaaggggcaggcac

SEQ ID NO: 88859 - DNA, 1006 bp, Homo sapiens
  misc_feature (727)..(727): n is a, c, g, or t
  misc_feature (734)..(734): n is a, c, g, or t
  misc_feature (747)..(747): n is a, c, g, or t
  misc_feature (759)..(759): n is a, c, g, or t
  misc_feature (769)..(769): n is a, c, g, or t
  misc_feature (777)..(778): n is a, c, g, or t
  misc_feature (812)..(812): n is a, c, g, or t
  misc_feature (818)..(819): n is a, c, g, or t
  misc_feature (822)..(822): n is a, c, g, or t
  misc_feature (839)..(839): n is a, c, g, or t
  misc_feature (864)..(864): n is a, c, g, or t
  misc_feature (881)..(881): n is a, c, g, or t
  misc_feature (886)..(886): n is a, c, g, or t
  misc_feature (894)..(894): n is a, c, g, or t
  misc_feature (897)..(897): n is a, c, g, or t
  misc_feature (923)..(923): n is a, c, g, or t
  misc_feature (946)..(946): n is a, c, g, or t
  misc_feature (953)..(953): n is a, c, g, or t
  misc_feature (962)..(962): n is a, c, g, or t
  misc_feature (969)..(969): n is a, c, g, or t
  misc_feature (973)..(973): n is a, c, g, or t
  misc_feature (978)..(979): n is a, c, g, or t
  misc_feature (983)..(983): n is a, c, g, or t
  misc_feature (985)..(985): n is a, c, g, or t
  misc_feature (988)..(989): n is a, c, g, or t
  misc_feature (994)..(994): n is a, c, g, or t
  misc_feature (1000)..(1000): n is a, c, g, or t
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaattctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaaaaaaaaaaaaaaaaaaaaaaaaaactcnagggggncccgtaccaattngcctatatgagncgatacaatnactggcgnngtttacacgtctgactggaaaaccctgcgtaccnactaanngcntgagaatccctttgcangtgcgtatacaaaagcccgaccgangcctttcaacagtgcanctgantgcaatgnaantgaacgtaatattgtaaatccgtaantttgtaatactatttttaccatngcgaatngaaaacctntaataangatnccgtnnggtngngtnncattngaaaancccttt

SEQ ID NO: 88860 - DNA, 746 bp, Homo sapiens
ctctgcagagcttccgctgcttcaaaacggcgtgcaggagtcagagacattacatcaggaagatactgcagagatattctactccatctcattcattgtacagattctaaactccctgaaggagacaaattaccagtggacaagaacacagcctctggagtccaataggcctggtgcattcattagggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagcta

SEQ ID NO: 88861 - DNA, 505 bp, Homo sapiens
gcccgcacattactcctcctcctctcgtcgcctgtggtgatgaaagcccttgttatgaacaaaagagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88862 - DNA, 497 bp, Homo sapiens
  misc_feature (1)..(1): n is a, c, g, or t
  misc_feature (25)..(25): n is a, c, g, or t
  misc_feature (43)..(43): n is a, c, g, or t
naaaaaaaaaaaaaaaaaacaaaanaaaaagtgtatggaaagnatttgggtcttcagctattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88863 - DNA, 670 bp, Homo sapiens
gagttttttcaaattgtcaagtctgcaaaaatttttccagtatatttattgaaaaaaatatgcatataagtgggacctgcacagttcagagccatgttgttcaagggtcagcagtagtcattttcatgattagatgtagagtgagcatgcagcaagttgtgaatatgaatacaattgaaacagataccactcttgaaaggagcacctctttttatgtttgtttcttttgcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88864 - DNA, 501 bp, Homo sapiens
aaaaagattttatatttaagttttaaatatatgacattattaatcccatattaatatgttagtattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88865 - DNA, 1237 bp, Homo sapiens
aagcagggtatcaacgcagagtgcccattacggccgggggacctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagctt

SEQ ID NO: 88866 - DNA, 946 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcaggaattattcataacctttatcacaggggtccctcctgcacaggaggtgagcggtgtgtgagtgaacattgcagcctgagctctgcctcctgtcagatcagcagcggcattagattctcataggagcgcgaaccctattgtgaactgcgcatgcaagggatctaggttgtgcgttccttattccttatgagaatctaatgcctgatggtgggataatttttatcctgaaacgatcacctttccccttccctacctgctgtggaaaaattgtcttccatgagactggtccctggtgccaaaaaggttaggaaccactgctttatcagatcttcagaggggacagggaatcaaattcgtataagaatcacagttctttatgatgtatatgctattttttgctgctaatctccagattttgtggatataaaatatattgtcatctgattttatttttttccaataaaatgtgatttcagtgatctttattttttctatctttaagtaatatatccctatactactatctcatcacttgtttaatttttgctaataagaatttgtcagttttactctttttttcccccaagggagaggcagctgttgggcagattccttttttttt

SEQ ID NO: 88867 - DNA, 432 bp, Homo sapiens
  misc_feature (254)..(254): n is a, c, g, or t
  misc_feature (274)..(274): n is a, c, g, or t
  misc_feature (349)..(349): n is a, c, g, or t
  misc_feature (394)..(394): n is a, c, g, or t
aagcagggtatcaacgcagagtgcccattacggccgggggacctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccggtatctcctgtggcaatgcacaaagtgatgcagctcacaatgctttgcagnatttaaagataatagcaganagaaagtaaatctggagcaacttaaaaaatctttcagtagcacataaaaagttcccctctggccccttcccaagnaaaacttttaccgtagtgtttatggtcttgtttctaaatctcttnataggattccattcaacactgccaggttttaattgatc

SEQ ID NO: 88868 - DNA, 364 bp, Homo sapiens
ctagagatgcttacttcctggttccttcagctctgattttgaagaactttcttccatagggatgtagtctacctgaggtgacatctgtgatagtacagagactggagaattatctcataattatctagtacctgtgtcttgaaaggtcagcatagttgaggcaggaactttaatcatacttcatatttttcttcagagttaggcacaaagggtcagtaatactgctttagtttatttgatgatttaaggatacttgatacttttaaattatttaatttaaaatgattataactggtcattttaatctggggcaggagtccatagaattgttttttaatttgagttttcttttttgtgtttgaag

SEQ ID NO: 88869 - DNA, 763 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88870 - DNA, 688 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagcta

SEQ ID NO: 88871 - DNA, 495 bp, Homo sapiens
  misc_feature (58)..(58): n is a, c, g, or t
cggacaaacataactattgttgtatcataattattaaatgcgagaacaaaccctttantattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaacaat

SEQ ID NO: 88872 - DNA, 819 bp, Homo sapiens
gaatgtatgaaactaataataggggcgacaccttgggagttttaaccccggcccggggcgcgctactcgtattcataaatatacaagtatgatcagcaatcgcgactcgaatctcgagagcggactctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88873 - DNA, 1106 bp, Homo sapiens
  misc_feature (750)..(751): n is a, c, g, or t
  misc_feature (931)..(931): n is a, c, g, or t
  misc_feature (939)..(939): n is a, c, g, or t
  misc_feature (986)..(986): n is a, c, g, or t
aagcagggtatcaacgcagagtgcccattacggccgggggacctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaataaataaaaaatnnaatatataataaaaacttcggggagtggcgctcggatcccaactttcgcctatattgaggtcgtattacaatttcactagcccgtcgtcttaacaacgttcgtgacttgtgaaaacccctgccgttatcccaaccttaatctgctttgcattgacaattcccctcttctgcacagttgcngtaattanccaaaaaaggcccgacctgatctgccctttccaaacagttgtgcatncttgtattgcaaatatgcaacattgtaacgcctaaaatatttcgttatgccgaaatctgtgagatatctccttataaattcaacagaaattaaccggcggatagggtagtagtgctgtct

SEQ ID NO: 88874 - DNA, 836 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaaataaaattaagttatttctaatctttaaattcaacttggcctgctggtttacacaactgtgttgaattgtggactcttggcgttacccctttttgcg

SEQ ID NO: 88875 - DNA, 761 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaacaat

SEQ ID NO: 88876 - DNA, 870 bp, Homo sapiens
aagcagggtatcaacgcagagtgcccattacggccgggggacctctctgtcagtcgcgagcgaacgaccaagagggtgttcgactgctagagccgagcgaagccaaaggctgaagatttcgtttctctttttaaagttgcgttttgtataaattctacaatagtggtttcagtatcagttacttgaattacaagctgcttctccccccacccccacattggaacaggctcattaaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88877 - DNA, 804 bp, Homo sapiens
  misc_feature (725)..(725): n is a, c, g, or t
  misc_feature (759)..(759): n is a, c, g, or t
  misc_feature (784)..(784): n is a, c, g, or t
  misc_feature (801)..(801): n is a, c, g, or t
  misc_feature (804)..(804): n is a, c, g, or t
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctactcctccttgcttctgggggtcgtggccttgctcccnctgtgcggggaaaaaatccaggcccttccccccnccttttggttccggggcccccaaanttgctcctggttccccnctn

SEQ ID NO: 88878 - DNA, 1012 bp, Homo sapiens
  misc_feature (733)..(733): n is a, c, g, or t
  misc_feature (740)..(740): n is a, c, g, or t
  misc_feature (753)..(753): n is a, c, g, or t
  misc_feature (765)..(765): n is a, c, g, or t
  misc_feature (775)..(775): n is a, c, g, or t
  misc_feature (783)..(784): n is a, c, g, or t
  misc_feature (818)..(818): n is a, c, g, or t
  misc_feature (824)..(825): n is a, c, g, or t
  misc_feature (828)..(828): n is a, c, g, or t
  misc_feature (845)..(845): n is a, c, g, or t
  misc_feature (870)..(870): n is a, c, g, or t
  misc_feature (887)..(887): n is a, c, g, or t
  misc_feature (892)..(892): n is a, c, g, or t
  misc_feature (900)..(900): n is a, c, g, or t
  misc_feature (903)..(903): n is a, c, g, or t
  misc_feature (929)..(929): n is a, c, g, or t
  misc_feature (952)..(952): n is a, c, g, or t
  misc_feature (959)..(959): n is a, c, g, or t
  misc_feature (968)..(968): n is a, c, g, or t
  misc_feature (975)..(975): n is a, c, g, or t
  misc_feature (979)..(979): n is a, c, g, or t
  misc_feature (984)..(985): n is a, c, g, or t
  misc_feature (989)..(989): n is a, c, g, or t
  misc_feature (991)..(991): n is a, c, g, or t
  misc_feature (994)..(995): n is a, c, g, or t
  misc_feature (1000)..(1000): n is a, c, g, or t
  misc_feature (1006)..(1006): n is a, c, g, or t
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttaatgtgcattattaaaaatattgagtgaagctaattgtcaactttattaaggattactttgtctgcccaccacctagtgtaaaataaaatcaagtaatacaatcttaaaaaaaaaaaaaaaaaaaaaaaaaactcnagggggncccgtaccaattngcctatatgagncgatacaatnactggcgnngtttacacgtctgactggaaaaccctgcgtaccnactaanngcntgagaatccctttgcangtgcgtatacaaaagcccgaccgangcctttcaacagtgcanctgantgcaatgnaantgaacgtaatattgtaaatccgtaantttgtaatactatttttaccatngcgaatngaaaacctntaataangatnccgtnnggtngngtnncattngaaaancccttt

SEQ ID NO: 88879 - DNA, 1065 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcaggaattattcataacctttatcacaggggtccctcctgcacaggaggtgagcggtgtgtgagtgaacattgcagcctgagctctgcctcctgtcagatcagcagcggcattagattctcataggagcgcgaaccctattgtgaactgcgcatgcaagggatctaggttgtgcgttccttattccttatgagaatctaatgcctgatggtgggataatttttatcctgaaacgatcacctttccccttccctacctgctgtggaaaaattgtcttccatgagactggtccctggtgccaaaaagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaa

SEQ ID NO: 88880 - DNA, 564 bp, Homo sapiens
  misc_feature (456)..(456): n is a, c, g, or t
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatccagacacggcattcccccccgtaaagcccgtgtccttccattcccccctttnccaacgacgcagcctactgcaccagctccccgcccaatcgccgctcttctcccgctccaacccactcctgcccaaactatctctccaaacctcactcactcctctccg

SEQ ID NO: 88881 - DNA, 693 bp, Homo sapiens
agcggatcacgtgaccgcagccccagcgcggcggggccggcgtctcctggctgccgtcacttccggttctctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaacaat

SEQ ID NO: 88882 - DNA, 1079 bp, Homo sapiens
cataaaatgtactagtgttatagatacacaaaggaggaagataaagaaaacttatctccacagaaaatcacaaaatcacagtgataaacattgagaggaaaaaacaaaggatatacaaagcaatcagaaaacaactcacaaaatgacaagagcaagtcttcacctgtcaataacagccttgaatgtaaacggattaaattccccacctaaaagttatagaaagactgaatggattaaaataaacaaaaaaacaaaaaaccccattacccaactgtatgctgcctgcaaaaaactcacttcacccgtaaacacacatatggactgaaagtgtaggtatggaaaaagatactccacacaaagcaaaaccaaaaccaggcaagaatagctatgcttagataaaatagactatatccaactgtaaaaagagacaaagaaaatcattatataatgataaagagatcaattcaaaaggctaaaacaactgtaaatatatatgcaccgaacaccagagcaccaaaataaataaagccaatattcttatatttcaaggggctctcacacctgtaatcccagtactttgggaggccaaagtgggaggaatgcttgagcccaggagtttgagaccagcctgcgcaacatagtgagaccttgtctctagaaataatttaaaaattaggctaggtacagtggctcatgcctgtaatttcagcactttgggaggtcaaggtgggaagatcaccttgagtgcagttcaagacctgcctgggaaacatactgaggccccacctctattaaagaaataacaaattagccatggtgacacacacctgtagttccaactactcaaaaggctgaagcaagagaatcacttgagctcaggaggtcaaaactacagtgagccgtaattgtgccactgcactccagcctgggtaacagagtgagactctgtctcaaaaaactaaaaaaataaatgggcacatagactccaactacaatagtagttggggacttcagtcatccagtctcagcactggacagatcatctagacagaaaatcaacaaagaaacattagatttag

SEQ ID NO: 88883 - DNA, 600 bp, Homo sapiens
ttattattatgccttatacatgcataattgatgttctttatattttaaaaagtacttagtggccaggcaaggtggctcacacctgtaatcctagcacttcgggaggttgaggcaggaggattgcttgaggccaggagttcgagaccagcctgagcaacatagtgaggccccatctctacagaagttttttataaattagctggccatggtgatatgtacctatagtcccagctagtaggaaagctgaagtgagtggatcacttgagtgcagttcaagacctgcctgggaaacatactgaggccccacctctattaaagaaataacaaattagccatggtgacacacacctgtagttccaactactcaaaaggctgaagcaagagaatcacttgagctcaggaggtcaaaactacagtgagccgtaattgtgccactgcactccagcctgggtaacagagtgagactctgtctcaaaaaactaaaaaaataaatgggcacatagactccaactacaatagtagttggggacttcagtcatccagtctcagcactggacagatcatctagacagaaaatcaacaaagaaacattagatttag

SEQ ID NO: 88884 - DNA, 351 bp, Homo sapiens
ttattattatgccttatacatgcataattgatgttctttatattttaaaaagtacttagtggccaggcaaggtggctcacacctgtaatcctagcacttcgggaggttgaggcaggaggattgcttgaggccaggagttcgagaccagcctgagcaacatagtgaggccccatctctacagaagttttttataaattagctggccatggtgatatgtacctatagtcccagctagtaggaaagctgaagtgagtggatcacttgagcccaggagttcagggctgcagtgaactatgatcacaccatggcattccagcctgggcaacagagagagaccctgtgtctaaaaaa

SEQ ID NO: 88885 - DNA, 545 bp, Homo sapiens
tgctttaaaaaaataccccctaagcacagtaatgcattttgttattaaggaatagaaatgcaaattttgagtgtgaaaatttgatctagtaaacaaaaatcaacctctaagacccttttaacctaaaattgttttcagagtcttcatgtcttttcatatgttcatccctttcttttttttttttgtttttttttttgtgtgtgtgtgttttttgtttttttttgttttgtttgagacatagtctcactctgtcacccaggctggaatgcaatggcacaatctcagctcactgcaacctccacctcccaggaggattgcttgaggccaggagttcgagaccagcctgagcaacatagtgaggccccatctctacagaagttttttataaattagctggccatggtgatatgtacctatagtcccagctagtaggaaagctgaagtgagtggatcacttgagcccaggagttcagggctgcagtgaactatgatcacaccatggcattccagcctgggcaacagagagagaccctgtgtctaaaaaa

SEQ ID NO: 88886 - DNA, 127 bp, Homo sapiens
gtccaagatgacagtttgtaattggaggagaagagcccctatcagcatcgctgtccagaagaaacataagacaaaccacacaggtcattctaaattttctagaaggcacatttctttgacacttatt

SEQ ID NO: 88887 - DNA, 151 bp, Homo sapiens
gttccatttcatttaagttgtcaaatttatttgtgtagaattactcctaatatttcaaattattctttggatgtctgcatggtctttagtgctatcccatgtttcattcctgatgttactaatttatgtcttctctcttttctgtcagttt

SEQ ID NO: 88888 - DNA, 3741 bp, Homo sapiens
taaatgttagacacacaagatgagcatcaatatacaacacctatctttataaattgttatattcaagagttattattgcagattggaaggtactttgttcctttgcgtaaaagtctttttttttttttgtagaaacagagtcttactctgtcacccaggctaaagtgcagtggcatgatctcagatcgctgcaacctccgcttcccgggttcaagcgattgtcttgcctcagcctccagagtagctgggattacaggtgcccgccaccactcctggctaatttttgtatttttggtagagacagggtttcaccatgatagccaggctggtcttgaattcctggcctcaagtaatccacccacctcggcctcccaaagtgctaggattacaggcatgagaaaccacatccagctgaaaggcatttaatttatagtttcctccctcagctctccccaaatacaggggtcatgagaggtatagagaagacagaatagatattcaattagaactctgctcaaccttatcttataactgttacctttcagtattgatcagttatttctattttgagatttaaataggcatagattttctttggttttctttttcttctaaatttttttcttgccacacccaggggcagctcgaattatttgtttttaagttcaccttttagactgatttgcctacctactccctccttctttccctttctccctccctccttccctttttcccttttcttttttttaagatggagtctcatgcttgttgcccaggatggagtgcggtggcacaatctcggctcactgcaacctccgcctcccaggttcaagcgattctcctgtgtcagcctcccgagtagctgggactacaggcacgcaccaccactcccagctaatttttgtatttttaatagagacaaggtttcaccaagttagccaggctggtctcaaacttctgaccttgtgatccacccacctcggcctacctaagtactgggattacaggcgtgagccagtgcactggcctattatctctttttaacaaagaattaagaaatctaatattctttcccaagatcgtacaaagaattgtggcaaattaggaattagatttttgtcttaattcaaaacctggtatttaccccagtgtgccaaacagctttataatgaagacaacattaatcaagcatcacatttttaaaggcatatatctatttttttggctatgcaaaaaaccttgtctctattaaaaatacaaaaattggctaggcatttcaaatgtgatacaataaaatattaacacaaaagtaatttctatttataaaatttaaaatggcaggttttctgtgtgacgtttgagtttgagatgatttgactggcatgaggcccatcattgggaggtaaaaattacagcacaaagaaaactaagcaggtgcatatgaggtattgtctctttatgctcatcaaaaaataatctccaaaagaaaagttaaaaaaattattgttataaattgcatgaaatacatagtgggctcgattcatagcccccgtccgtatctatatctctatatctatagagacataacttctttcttcgtaagttatatatgtctacttctacctgtgttatcataataaaggtgtcatgatgatacaggtggaggtagaaatatataacttatctcttcataagggctaaaatgagaactaaaagtaatgagaattcagttgaatatgattaattatcaggatatgttaattagttctcttgatgcttactgtgatgcaaagtatgtgacgtattttaaacattttataataattgttcgtatgttaaccattaggcaagatttgtatttctaatgcttttaatgttcttttaaaataatgtttggaaaataaaaatactgaaaatcctaacatttctgaacaccagtttgcaatataatgaatttcctgtctgatcattttaaaactatcagagcatggcaatgatcatttttgcccaatggataacaatgtgttgaaccacagacagagagctctttgccttaagagatgaaataacttgtttgactatatataaatttttttttttttttgtagagacggggtctccctatgttgcccaggttggtctccaactcatgggctcaagcgatcctcccgcctcagccttccaaagtgctgggaatagaggcgttacattttgtatcatatatgctcagactaatcaaggatagttaatgccaaagactatttacaaaactaagtttcttactcagtgaaaagaggctaaatgaacatttgagcaactcatttaaatgaaatttagctggaaaaagaaaaattttgaatttttggtttatcgatcagggtctggatttaagaatcaaaaaacattaacataagcaggaaagcatttaatataggaaactagatgtctacagaatggttagatagggctctatgatgagtctccaggaaagattgcaccataaacatgaccagccggaccagccataaatgctactacttctgctccaaccaagaagagaggaagtcaggaagcctaccttggacttttgacttcaagaacacactgttaaagttgttgtccaccagtgaggaagttgctgccactactatttccacaaaaaactctcttgacacctacaaagcaagtggctgaacaacaagacactgctatagaaaaaatctggcaccatgcagttagatggggaaactaagtttgcatctagaaccctagcttcagggaaatctggaaagtgtactaacacaaaagtatactcaaaggagatgcagagttctaatctgttctgtccacagaggttcaccttggtagtcaacatttgtttttttttttgagatgggttctcactctgttgcccaagctggagtgtagtggtgcaatctcggctcactgcaacctccacctcctgggttcaagcgattttcctgcctcagcctcctgagtagctgggattacaggcatgcgccaacacgcccagctaatttttgtagcagagacggggtttcaccatgttggccaggctggtcttgaactcctgacctcaggtgatccacccacctcaccctcccaaagtgctgtgattataggcgtgagccactgcatccggccagtagtcaacattttttatacatacctctagccatactcccaaacaacagcagtagctataccaccattctccctcttgaaataatgcagcttctctcatttaaacaaaaatatgtactttgctaggcgctgcatagcaatctcagcactttgggaggctgaagtgggaggatcgcttgagcccaggagtttgagacccacctgggcaacgtgacaaaaccccgtttctacagaaaagttacttgggcatggtggcaggtacctgtagtcccagctactggggaggctgaggtgggaagatcgcctgagtgagtccaggaggcctaggctgcagtgagccaagatcacaccagtgcaatccagcctgcagtgagatcctgtcacaaaacaaaacaaaataaaaaatgcatactctcctccagagggaagatgctaagtctgatcaatctctgggtttctcagtgatgttcattattcttctagttcagtcaaaaatctcaacgtgatattctgtaacctaaggaccaaattataaaatttaccaccaacaaacaaatttaatcatcaagagta

SEQ ID NO: 88889 - DNA, 1924 bp, Homo sapiens
taaatgttagacacacaagatgagcatcaatatacaacacctatctttataaattgttatattcaagagttattattgcagattggaaggtactttgttcctttgcgtaaaagtctttttttttttttgtagaaacagagtcttactctgtcacccaggctaaagtgcagtggcatgatctcagatcgctgcaacctccgcttcccgggttcaagcgattgtcttgcctcagcctccagagtagctgggattacaggtgcccgccaccactcctggctaatttttgtatttttggtagagacagggtttcaccatgatagccaggctggtcttgaattcctggcctcaagtaatccacccacctcggcctcccaaagtgctaggattacaggcatgagaaaccacatccagctgaaaggcatttaatttatagtttcctccctcagctctccccaaatacaggggtcatgagaggtatagagaagacagaatagatattcaattagaactctgctcaaccttatcttataactgttacctttcagtattgatcagttatttctattttgagatttaaataggcatagattttctttggttttctttttcttctaaatttttttcttgccacacccaggggcagctcgaattatttgtttttaagttcaccttttagactgatttgcctacctactccctccttctttccctttctccctccctccttccctttttcccttttcttttttttaagatggagtctcatgcttgttgcccaggatggagtgcggtggcacaatctcggctcactgcaacctccgcctcccaggttcaagcgattctcctgtgtcagcctcccgagtagctgggactacaggcacgcaccaccactcccagctaatttttgtatttttaatagagacaaggtttcaccaagttagccaggctggtctcaaacttctgaccttgtgatccacccacctcggcctacctaagtactgggattacaggcgtgagccagtgcactggcctattatctctttttaacaaagaattaagaaatctaatattctttcccaagatcgtacaaagaattgtggcaaattaggaattagatttttgtcttaattcaaaacctggtatttaccccagtgtgccaaacagctttataatgaagacaacattaatcaagcatcacatttttaaaggcatatatctatttttttggctatgcaaaaaaccttgtctctattaaaaatacaaaaattggctaggcatttcaaatgtgatacaataaaatattaacacaaaagtaatttctatttataaaatttaaaatggcaggttttctgtgtgacgtttgagtttgagatgatttgactggcatgaggcccatcattgggaggtaaaaattacagcacaaagaaaactaagcaggtgcatatgaggtattgtctctttatgctcatcaaaaaataatctccaaaagaaaagttaaaaaaattattgttataaattgcatgaaatacatagtgggctcgattcatagcccccgtccgtatctatatctctatatctatagagacataacttctttcttcgtaagttatatatgtctacttctacctgtgttatcataataaaggtgtcatgatgatacaggtggaggtagaaatatataacttatctcttcataagggctaaaatgagaactaaaagtaatgagaattcagttgaatatgattaattatcaggatatgttaattagttctcttgatgcttactgtgatgcaaagtatgtgacgtattttaaacattttataataattgttcgtatgttaaccattaggcaagatttgtatttctaatgcttttaatgttcttttaaaataatgtttggaaaataaaaatactgaaaatccta

SEQ ID NO: 88890 - DNA, 418 bp, Homo sapiens
gtatatttctttgaacctgattcttcattaataaattgacctttcttctttgaactcgtgtcccttgttcatatttcatgatacctataacatttcattgcagttactttacatgtctatcagtgtaagctcatcaagataaaaaaaattgttctttggatcccttaacacacatacagtatatagcaaggggttagattaattgaattaatgtttatttattttacagaagggtaggaattagatgagctgtgttagtgtcaggcctgttttttatgtgcctgacatccagaatgggcatagtgaaaggctcatatatagctgtatatacaaagcctttctaatagaggggagtcagtgttggtaaaaacccagttcatgtaagttgtaaaacatgtcttcggattggttctttgca

SEQ ID NO: 88891 - DNA, 466 bp, Homo sapiens
gaacgggaagatctatccttgtacttggtgtaggactacagctgaaaaaatgttaagaaatgaagaaatttcttaaaagaaatgtgcagtttccttgcaggagaaaagaagcagcaatatgtatccttcaaattagaggactcataaattattattggaaggaaggatgcagagatggatggaaggaaggatgtcaccacaagaagaagaaggggggacggcaagatgtagaagagagatgggacaagcaaatgtctcttcacagacaaggacaccaagaataaaggctcagacagaacatgttctttgtcactggaaagagatacaacttttattcctccaattccccagttaaaaggaataaatggcaaagacagatgtcttcccaaagagtcaacagatcttctgtcaagcagctgcaagagaatgtgaagtcccctggcacgttcaatctcattgctaccat

SEQ ID NO: 88892 - DNA, 218 bp, Homo sapiens
cttaagatttggaatccatgttttatttcttatcaatgggcaactggggaatttttaaaacttctctgaactttagttttcttgtatgtaaaatggagctaatacaatcagcttccaacttgtaatatgtttactgaggttaacacataaaatctcggccaggcacggtggctcacccctgtaatcccagcagtttgggaggctgaggtaggcagatc

SEQ ID NO: 88893 - DNA, 412 bp, Homo sapiens
tgctttcctgaagctggaggaggtggggaacgtacttcctaatttttaggatgtctctggctttttacatccatgactcccctaaactctagaagcatgcattagctatctcttgatgtgcaacaaattatccctaaactttgtggcttggagcaacaacagtttgtgtctgtcagtaaatccaaagacagttcaactgggtcctctactttgtactttggggtctcttacaggctgaaatcaaggtactggctggggctacagtcatggcttctgaggtacagggtcccagagggagattataagtggatgcatctaaaccctgtcaaagtttaatgggaaaaattcacttcccagctcacttgcatggttgttggcatgaatcagttccttgcaggctgttgcactaagg

SEQ ID NO: 88894 - DNA, 209 bp, Homo sapiens
tcctcacagcccctcactcagcaatccagtgtccagtctacctgggacagatttggcacatgccagtgactgtccaagtctctaggagggaaggcacacagcccatccaggtgcacttagcaggggtgtgaggggctagcttgaagacccctgacaggtgccacactggccccccttgactcagacccctaagcgggcttcaggctctc

SEQ ID NO: 88895 - DNA, 190 bp, Homo sapiens
gatcttcgctccagctttctgcatctgagctggaaaaagagcaaaaacgggtaaaaattgaatccaaatattgtcggatgtatgcctaatttagaatgaaatcttggggtggcagactctggagttctctgtgaggtgtggcattcttttctctaaatcacttatttgccaatgtatgtgtcactttgtt

SEQ ID NO: 88896 - DNA, 183 bp, Homo sapiens
aatgaaataaagcctgatggttatttccttgaatgtattccatcctgtagccaatactggtttatacccctcgtttgtttaaaaagtaaatggatgacttagatgatttagatttagatttcacacatttttctcctagcttttaaaaagtactttctattaaagctgtcataacaaatgacc

SEQ ID NO: 88897 - DNA, 537 bp, Homo sapiens
cctgagacacccggggaggagggtatatgagtgggaggctgtataatacacttggttgcaatcccagatccacctctttctatttatgcagctccaagcaaattacctcatctctctttgccttggtttcctcatctattaaatggggattagaagagactgacttcatagagtcgttgtgcgaaaatgagccagtgtattgtaatgagtctagaattgtgcctctaccacaaaataagtcctcaataactattagcttactactcccagcgtcaccaccaccactaccgctacctctactattattaaatgagagggaaagaacaacgaaaatactgtttaattagcaaaactaagaggtaatgagggcctgaattaggtgccagaacaaatggacagattgcagaggtaacagagataatgagcctatagaatttagcatctaatcccccaaggatatgatttaattggtctggggtgcggctggtatcttagtttttaagctccccaggagattccaaggggcagccagagtcg

SEQ ID NO: 88898 - DNA, 1411 bp, Homo sapiens
gaagtatgtccgacaagcctggcagaaggcagacatcaatacaaaatgggcagccacacgatgggccaagaagattgaatgattggagaaagtttaaattagagagtcaagacagtgattcaattccacctagcaagaaggagattctcaggcaaatgtcttctcctcagagtaggaatggcaaagattcagaagcagtagacagggattctcacccactcaacaaggacaccaggcacagagatccaaactattatatcaaatccagtccctaaaatggaagaagccaaaagccaaagtttggaggaagactttgaaggacaggccacacatacaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtatgggcacggctatgctaacttgacaaaaatgactgatgcaacaatcgagttattagcatttcttagtattagttactcaaattgatacaatgcttgactacaaaacagagctgtcttcagcaacattattagtagacaaagaggatgtggataatattatgacatttttcaaaaatccctttcaagttatgttttgtcttttttactccattttccctcatcactgttattatttggacttttcaaattacattattcattataattttctttgtgtaataaaaatgaaatctcatgaggaaat

SEQ ID NO: 88899 - DNA, 1172 bp, Homo sapiens
caaatgtgtggagatttattttataatagcaatgtgaggaataccttcctaattatgacaaaaacaaaaacaacaacaaaaagaccattgaagaaaaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtatgggcacggctatgctaacttgacaaaaatgactgatgcaacaatcgagttattagcatttcttagtattagttactcaaattgatacaatgcttgactacaaaacagagctgtcttcagcaacattattagtagacaaagaggatgtggataatattatgacatttttcaaaaatccctttcaagttatgttttgtcttttttactccattttccctcatcactgttattatttggacttttcaaattacattattcattataattttctttgtgtaataaaaatgaaatctcatgaggaaat

SEQ ID NO: 88900 - DNA, 1322 bp, Homo sapiens
caaagaaggcaaataactctcaggagccttctccgcagttggcttcctcggtagcttccacacggagcatgcccgagagcctggacagcccaacctctggcagacccagtagacagggattctcacccactcaacaaggacaccaggcacagagatccaaactattatatcaaatccagtccctaaaatggaagaagccaaaagccaaagtttggaggaagactttgaaggacaggccacacatacaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtatgggcacggctatgctaacttgacaaaaatgactgatgcaacaatcgagttattagcatttcttagtattagttactcaaattgatacaatgcttgactacaaaacagagctgtcttcagcaacattattagtagacaaagaggatgtggataatattatgacatttttcaaaaatccctttcaagttatgttttgtcttttttactccattttccctcatcactgttattatttggacttttcaaattacattattcattataattttctttgtgtaataaaaatgaaatctcatgaggaaat

SEQ ID NO: 88901 - DNA, 515 bp, Homo sapiens
taagcaaatttattattctgacttttgttttacagctgtctataatgtttctaaatctcttaatatggtggtttctcctttaatctatattatcttctgatggttttagagcaatgtaatgaatgtctgctatttatgcctgcctagcatccattcccccttcttctgttaacatcaccttaattctcctttgagaaacccccactttcagtccatgtggttctaggaaaattgccccattccctgggtacaggtctgaggtgacctgatataggcctggccaaatagaacatctggtacccctcagccacatgattggaacatggatgagtaaggcccagtatttttggctggaatgactgggaaagagatattacaaagacatcagttctctccaaattaatttatggatttaatataattttaatcaaaatcccagaggatttaagaatgataaaatcattccaaaatttatctggggaaataagtaactatactataccagccggcaattg

SEQ ID NO: 88902 - DNA, 492 bp, Homo sapiens
tcagagacctttggagccagaggtgacatatcgatctacatttaaccctctgggaaccaaggaatgaaggattagaggaaacggggccagaagtggagagaaggggagtgtgcatcgaacagacagggagtgtattaaataaatgaatgagtgaatgaatgatccatccatatggacactagcctgtcagtaaagaagagtctagggtcagggagagctcagccctcctcaggccgcccccatgatgacatagccttgggctaggggaaatctgaggtcaggccagctgcctggcaggagttgagaccccagaaggaaggtggagggcaggaacattccccagccccagggtgggatctcagcccaaggagatggggttcccaggccagggtctgccttgggcaggcagatgggtgccaggtgggccctgggtcaccactgggggccagccccagcccagcgtctgcctcccccactgcccagcctctgttc

SEQ ID NO: 88903 - DNA, 354 bp, Homo sapiens
aggagaaagcttttgagctggaagggtatgttaacgggcataaaagagttgatgggcagtttaggcagcgtgtacagcagaaaacaatgtaagtagtccgcaactctgtggcctctatgcagaattcaggctactataactgacatttactaaggctcagctaaccctctccctcagctactctcctatgtccaaaccaaatgagaccctacggcatccagccttcaccgtagtctgacttacattccaacctgccaagctaattcacagagagaggctgctccccgcccacggtatcagaaatgctctcgctgtaaatgagcaccactgcctcgttcttacctaagtcccaca

SEQ ID NO: 88904 - DNA, 453 bp, Homo sapiens
tatgtaggaagattgagaagagtaaatagctccaaaagaaaaaacaaagtaaaacagaacaccaagtaggagaatatcaactgtaagtatacgccaaagtgaattaaaatccaccatggagaagaacacgcatgctgagaggggctctctccttggctctgccgtcctgaaggcagtgtggggagagaaggagctggcttttgatagcaatacggacactctgggagctgtgctgaatgtttcatactttccttaatgtaatttccacagcatcaccacaatcattactgtctctgctgtacatggggaaaagcttgagttaacagaagttaaacaattcaccagtgatcacacttacatgaaaaagccaggtattctatctgtctgataacttgagcctggccattacattcagttctgctgtctttaaaataaaaaccctggattaagtca

SEQ ID NO: 88905 - DNA, 220 bp, Homo sapiens
tgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggact

SEQ ID NO: 88906 - DNA, 455 bp, Homo sapiens
tctccaagttttgccttctccagaatgtcatagagttggggtcatgcaatatgtagccttttcagattggcttctttcacttagtaatatgcatgtaagattccaccatgtattttcatggcttgacagctctgtttttagcactgaataatattcagttgtctctatttaccacaacttatccactcacctacagaaggtcatctagattgcttccaagttttggcaattatgaataaagatgctatagcaatttcatcttttaaggacctcctaaatatttcagaccctgtcactatatttattatgtatcaattgaacccctggatttctcctcatatggtccagctttttcctacaaatctagctgcagatttcttctcttgtctgagaaacaaccaatgaaactttcacttttgtcgttttatgtattccttttactattaaaaaattaa

SEQ ID NO: 88907 - DNA, 609 bp, Homo sapiens
ttccaaaatcagagacagagtgctcccggtgccatgaacggagacgacgcctttgtacggagacctagggttggttctcaaataccacagaagatgcaaaaggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcaaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctccggaagatgacgagtaactcccctca

SEQ ID NO: 88908 - DNA, 732 bp, Homo sapiens
ttccaaaatcagagacagagtgctcccggtgccatgaacggagacgacgcctttgtacggagacctagggttggttctcaaataccacagaagatgcaaaagcatccctggagacaagtctgtgaccgtggaatacatttggtgaatctcagtccgttctggaaggtgggaagagagccagccagcagcattaaagctctactgtgtggcaggggagaagctagggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcaaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctccggaagatgacgagtaactcccctca

SEQ ID NO: 88909 - DNA, 1023 bp, Homo sapiens
cacaccacctgagtcaggaaatggattctcccttagaacctatagaaaggaatgcagccggccaggcacagtagctcatgcctgtaatcccagaactttggagactgaggcaggtggatcacccgaggttaggagtccgagatggcgccattgcactccagtctgggcaacacagcaagactctgtctcaaaaaaaaaaaaaaaaaaaacatgaaagaaagtaaagaaaaacaggaatgagaaactgagaaacagaagggacagaaaaaaaataaatggcaaacataagccctaacacatcaataattattatgaattttaatgatctgaatacactaattgtaatacaaattggaagagtagatacagaatgtaatccaactatgtgctatgtacagtaagctgacttcaaaacatggttgacataggtaagttgaaagtaaaaggatagaaaaagatgtgtcatagaagtattaatatactaatgaaataatcaggagtgtattaatatcagatgcagtagacttcaaagcaaagaaaattactagggataaagaggggcattatttattgatgaaaggatcaatctaaagaagacataatgatccttacttttgtatgcaccaaacaacaaagcttaagctacataaataaaaactgatagaattaagaagaaatttaaaaatccataattgtagatgggatttcagtatccacacccagtattgacagactactgtaaatataatcagcgaagatatagaagaactgaagaatgtcatcaactaagaggatccaattgacatttatagaacactttacccaacaacagaatacacgttactttcaagtgtccataaactattcaccaagatagaaccatatcctgggtcataaaactcaattaaagaaaaattcaactcagagcaatctctttccgaacacgagcaccacaggcgcccgaaggccggaacaggcgtttagagaaaatggcagacgatattgatatttgagcaatgcttg

SEQ ID NO: 88910 - DNA, 566 bp, Homo sapiens
gagattcagttgaacctgggaggtggaggttgcagtgagccgagatggcgccattgcactccagtctgggcaacacagcaagactctgtctcaaaaaaaaaaaaaaaaaaaacatgaaagaaagtaaagaaaaacaggaatgagaaactgagaaacagaagggacagaaaaaaaataaatggcaaacataagccctaacacatcaataattattatgaattttaatgatctgaatacactaattgtaatacaaattggaagagtagatacagaatgtaatccaactatgtgctatgtacagtaagctgacttcaaaacatggttgacataggtaagttgaaagtaaaaggatagaaaaagatgtgtcatagaagtattaatatactaatgaaataatcaggagtgtattaatatcagatgcagtagacttcaaagcaaagaaaattactagggataaagaggggcattatttattgatgaaaggatcaatctaaagaagacataatgatccttacttttgtatgcaccaaacaacaaagcttaagctacataaataaaaactgata

SEQ ID NO: 88911 - DNA, 837 bp, Homo sapiens
aaacagtcatgtacgtgattttgtctaaacataagtttccatttcatttgtgtaaatacctaggaatgagattgctggttgtataatggtatgtttaagaaacaactttccacagtggcgatgccattttgcgttcacaccagcaatatgtaaaattgttccacattgttgtcagaacttacgatttgtcactttttggattttagccattctaacaggcatgtaatgggtgaagtgtgttcaaatcttttgcccacttttacatttggtggttttcctactgaattttgagaattctttagatactgtagatatacaaatgcttcatcagatatggaacgtgtacagattttctaatagtctatggctggttttttaattctcttaacagtgtctcaaatagcagaaattattcattttgataaaatccattttaacagtattttacggattgtgcttttgatgttgtatataaaattttcccataaaacatgttcactaagattttctgttgtcttctagaggttttgtagtttgagattttacatttatgtctgtggttcatttttagtttttgtatatagtgcagggtatgggaacaagtttactattattttgttatatgcacatccaattgttccagcaccatctgttgaaaaggctatcctttctctaccaaattgcctttgcacctttgttgaaaatcagtttaccatacatgtgttgtctatttcaggactctgttctgttctattgatctctgtgtctatacttccaccaacactactgtcttgattactgtggtgttataatacagatattttgtgtaccttcata

SEQ ID NO: 88912 - DNA, 348 bp, Homo sapiens
agtgttgggatgactggagagagccactgtgctgggccttgtttcttaattgttcatttaacaggcctggttggggtgtgaaatggagtccatgtgtgtattttgcatcctctgtaaatatggccgtagagtacattctaaacacagcctttctgatccactggcttttgtgcataccagggtatgacatcgtgttaaaaagaccgttagtgtagtgtattgtttttgtaaatgcagtttattctaagcacactatatgctggaattatttctagagttcatagtggtattatcattaaggtgtatggaaagtatactaattcctattctataggcaaaaacaactgg

SEQ ID NO: 88913 - DNA, 289 bp, Homo sapiens
ctaatttgagttgatgaaactgtgctttcctatctggattacaggtaagctcttttctacctgattggatcctgcatcctgcctatattgctttttaatctggctcatccagctaccattgtgtaatcattctgtgactaagataaacatggttccttagtcaaactgttttaaaaagctatttcagattaaatgattagtcatcgaatgcttattatagtcttttagataactaaggtaagatgcattctatttgaaactccagattttattttatttcttttcattt

SEQ ID NO: 88914 - DNA, 234 bp, Homo sapiens
gatctgcctgcctcagcctcccaaagtgctggtattacaggcgtgagccactgtccaaggccatcaatgtggaattttatacctagtgaaaatatctttcaaaaataaagatgaaataaaaacttgtttagatgaagtaaagatgaaaaaattagtcactggcagacctgtactgaaagatatgctaaaaaaagttcttcagacagaagaaaaatgttatcagttagaaacctg

SEQ ID NO: 88915 - DNA, 466 bp, Homo sapiens
aacatcttcctttctcaaataagctatatacaattcgagttggttctgtttaatttttaaaagtttgcttcccttcccaccaccactcccccaaaaccagcactatcatcaaacagcctgacaagaatctgcctaggctgggcttaataaaccctatattccaaagtgcttctcccctcccaactttccctccaaatcctgggctctttctcagtaaaggaaatcgtgttttctaatactagattaaagcgacatcttgttatatccaccaacacctttctctttacagttaaaaaaaaattcagacacacacacacccatatatatataaaatcattatgcaatcagttggagggagagcatgtatgccaacattgtagagactaagtgcccatttatccataattaagataagcagacttttccccactgtactataaagttagagtatcggcgttggctggaa

SEQ ID NO: 88916 - DNA, 505 bp, Homo sapiens
ttttttttttcttatttggcgaggcagtctcactgtgtcgcccaggctgaggtgcagtaatgcgatcttggctcactgcaccttctccctcccggttcaagcgattctcctgcatcagcttcctgagtagctggaattacaggtgtgcgccaccatgcccagctaatttttttatatttttagtagagacggggttttaccatgttggccaggctggtcttgaactcctggcctcaagtgctctcgaacgacctggcctcccatagtgctaggatacaggcatgaaccaccccacctgtctttacatgtatcataagcatttcaaattaattttcgtttacattgtgaaagagtggttcttccagtgtgaaagagtggttcttccactacataattggttgttccagcaccacttgtttgagactatcatgtcttcattgaatttttttttttggtgccttagttgaaaatcatttgaccacatgtatttgattctatttctgta

SEQ ID NO: 88917 - DNA, 437 bp, Homo sapiens
aagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaagggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatg

SEQ ID NO: 88918 - DNA, 393 bp, Homo sapiens
ctctatgaatggctggttgctcaatgctcacatacagttgtgtgtcagtatatgtgaactgctgatactaatatgagcttactgtaaaaagtgtaacttccatgtgttagatagaagatttgagaaatgtatacaggagtaagccaacattctataacatcttagttctgagagaagataaagagaatatcaatgtggtacttagggttggccaactatacccctatttagcctatgcctggttttgtaaataaagttttactggaacgcaggcacaagcattcatttaccacacgttgcacacggctgtttctcagaattgcatagctgtcacagcgagcacaaggttcacagggccaaaaatatttataaactggccttttaccaaaaaaa

SEQ ID NO: 88919 - DNA, 603 bp, Homo sapiens
gttttataaaaaaaaatcttagatggaatattttactcagccatttctgtagttaacatttgatagccacctgttgaagcagatagcttatactgactgcaccaccgctggtgctcagaattgagggtttttttgcaaatgatatctgacaaggtaaaactttctatttccgtacatggaggcaaaaaccccactttgcaaccattatcagaggtaagattgataataattcatttttttgtagtggcaaatataaatatgaatcatcaaagcaagtttcatatccattcatcagtattacttaacccagaagttaaggtggcttacggaattattagcaatggtaatttttttatcagtattgtgtaacatatcagatttattttatttaaagaattatttataccattaacagattcttatatatattaatgtggcaaaaatgtgcaggttaaatctattaaccaaattatttatattatattaagtaagaaaaaatgtgaaacaaatgtagagagaaaatactacattacaagtatacaaacctaaaactgtgagccattgtaaagtacaaggtaattaataagaaatgtagcacaacat

SEQ ID NO: 88920 - DNA, 368 bp, Homo sapiens
caaaatcctgtctcagaaaaaagagtcattggagggttttgaaccaagaaatgacagtccgacatacatttttaaaggatcaccaggctgggcacgatggttcacgcctgtcatcccagcactttgggaggccgaggcaggcagatcacttgaggtcagaagtttaagactagcctggccaacatggtgaaaccccatctctactaaaaatacaaaaattagccaggcatgatggcgtgtgcctatcatcccagttactcaggaggctgaggcaggaaaactgcttgagcccgggaggtggagattgcagtgagctgagattgtgccactgcactccagcctgggcaacaaagcgagactccgtctca

SEQ ID NO: 88921 - DNA, 420 bp, Homo sapiens
taactgtgcaaataatccatgaatatattgtttttatacagcattacagataaggcttgcagctctatagatcaccctcatccactccttcactccattgctacacttaaaagcctcacatgctctcctgtcctctccaaaggcagctgctagcatcagcgcccacagtagccttcttttgtttcctgtttataaaccatacattttctatggctacacatacgtgtattgtttgatgctttctaataaaattgtatcatagtgtacacatctttcacactttccttattacagtcaacatttggagaatacagaatgcagcagatcaagaactttctcagtctttctaacatgccccaaaatacagcctcactatggttcatttagcgtctcattgttttcactctcacaaacgatgcc

SEQ ID NO: 88922 - DNA, 317 bp, Homo sapiens
ctgtagtctcagctaatgaggaggctgaggcaggagaattgcttgagcctgggagatcaaggccgcagtgagctctgattatgccattgcactgcagctgagggcacagagctgaggccctgtctcaaaagaaaaaaattgtgtaaaagagcaaaataatttcattttcaaatatgtttttttgcatttttattttactggctgctttgttcctaatgatactcctctggaagcaatggcttagagcagtgaatcgcaactccagtcacctggggacttatttaaaaaataaacaaatactataaataaaactgcta

SEQ ID NO: 88923 - DNA, 581 bp, Homo sapiens
tttagtacagggtctctagaccctttcctgtcctcattcaactctcagcttgttgtggcttgtcagtgccctgaaatatgttatggccaaaatttaaaagtatacttcatagatcatataatttacaagtagagtacagcaggatttttaatggccttggtactaaagttatattgccaatagtgacccatggattagctgagttttgtttcgttctagtttttgaatggggaatgtacttttacataatacagttggctcaggttgaccttttagtcaggtgaaacttccaggttcttatctgtactaaatgcaggtaagcaaagtctccctcaatttccacatgcacagtttgcttttttaaacagatgtgcaggaattcacttgtatttgtataacttttagaaattgtctcattttaccttattcttcctgcctgctatcattcttacatatttatttttgtttgtttgtgtgagacagagtctcgctctgttgcccaggctgaagtgcagtgagccgagattgcaccactgcactccagtctggacaacagagtgaaactcagtctcaaaaaaaaa

SEQ ID NO: 88924 - DNA, 250 bp, Homo sapiens
  misc_feature (205)..(205): n is a, c, g, or t
atgggtgctccatcccccttgaaaatatctgtaccttcttttacaagagattctgagtctttccttctagagagtttaaagcacctgatctttgggaactgataagaactatctactgtggctggctgcaaataattccttgcatttatttttagtgttaatttcttttattctaatatacgtcatatgctttccattgtctctnggtttaaaatcacaaatgactactcctattatacaaggaattatt

SEQ ID NO: 88925 - DNA, 114 bp, Homo sapiens
tttctgaggtcagtttcttcctgagttgtcaaaagaaaaagaaaaacagcaaattctacacattttacaaaaataagaagactaaaatatgaaacaagctacatttctgggatc

SEQ ID NO: 88926 - DNA, 300 bp, Homo sapiens
ttgtgtgtatcttgtgagaaacactttagtcaaactaagccattgttaaaggaaaagaagtgaaggcatttggttgccttcctaataactaaatattgagttgtggagaacactgtcttatcagtgagtttgttcccatattcctttctgaattaataggaagaacctccctcatctctaattctactaggctactactctatctccctcctgcttttcatcgccaaacttttgagtccttcacctaatcagactatgatatctctaggtagtcgtcaccctccaaattacgtttctgct

SEQ ID NO: 88927 - DNA, 397 bp, Homo sapiens
cccctgaccatagttttctatgtgaccttaagttagcaacttaacctctctgtggctgtttcctcatctataaaatggaaccataacacctaccttgtgggactggactgagtattggatggaagccaaactctttgcatgtcataaggctcttccatggtagctgtcctgcccctcctttgagctcctgtgtatttgagcagagccctgtccctgtctgcacctccatttctgggtctgtgaaaaggagaaggtgggacaagctgattccaacagcccctccagcctgaccagccatgatagatgacttcaggccaggccagtcctcctctggagccacaggaatgtgaacaaggggccacttgggggcaaaagagtttcctgcagcagcgtgttt

SEQ ID NO: 88928 - DNA, 387 bp, Homo sapiens
gagatataaaattaccgagatttaactgaaggcagctgtcaaactctgtaaaagaactgatattcttcagaggagtgcaaattctatgtcaaagacacaaaacagattcttattgcttaataatctcccacagttcaatagtgacagaaattggtttcctttttgccccctacccctactgtcttatttctacaattttctctacagttaccagttttgggatgactgattctggtgtttactatatgatcacttgatcaatggagacctgcccatcctgcttctgactatcgtgatgtcatagtagagctgctttagatgaatccgaagtactcactcctttctccaatttcttcttatctggtttaagaaaacagtaacttattt

SEQ ID NO: 88929 - DNA, 109 bp, Homo sapiens
cctgcccccaacccctatccatttgggtagacacaagctcaggctgctaaattcagggacatgctcgactttgggggagctctgagggcatggctaaggccttacaggg

SEQ ID NO: 88930 - DNA, 5456 bp, Homo sapiens
  misc_feature (597)..(597): n is a, c, g, or t
  misc_feature (687)..(687): n is a, c, g, or t
  misc_feature (698)..(698): n is a, c, g, or t
  misc_feature (717)..(717): n is a, c, g, or t
  misc_feature (847)..(847): n is a, c, g, or t
ctttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgctacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagntgtatcgctcaactaaaagattgaaggatgctgtggcccactgccatgaggcagagaggaacatagctttgcgttcaagtttagagtggnattcgtgtgtngtacagacccttaaggaanatctggagtctttacagtgtttggagtctgataaaagtgactggcgagcaaccaatacagacttactgctggcctatgctaatcttatgcttcttacgctttccactagagatgtgcaggaaaatagagnattactggaaagttttgatagtgctcttcagtctgcggaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgcttcacctggaatccgaaaatggctaaaacagcttttccatcgtttgccccatgaaacctcaaggcttgaaacaaatgcgcctgaatcgatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggaggagtgttcattattggaagaaagttttgccattgttgaagataataaagaagaacagtattcctgaacctattgatcctctgtttaaacattttcatagtgtagacattcaggcatcagaaattgttgaatatgaagaggacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgtctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcaggtaatgttactcccacaaagggttcttctaatacagattttaagtccaccaaagaaggattttccatccctgtgtctgctgatggatttaaatttggcatttcggaaccaggaaatcaagaaaagaaaagggaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattctcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtcatttctctgatggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctatattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgtatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagccttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccctatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttac

SEQ ID NO: 88931 - DNA, 780 bp, Homo sapiens
attgggaacagagaagggaagcataatgaccagtttatggtcaaggcacagaccagattgaacgggggcacagcatttgggatgagtttttatggatcagaaattagccaaagaaagaggtaagaatggctgctggcgaagggtattctggtcctgctacagtgatgaatcacagatttttttctaggggactctagctcgttattcatactatttggatcataatgctgagagacaccatcccaaatgctataatcctgaatgttgaaatctcaaaagatcaaaatccctgaaggtcaaaatctctaaagtctaaaataacgaacctctcaaatactgaaaatcacagtcactctgttaggtggaactgttaccttgtcattgtctttatttggaaattaaggtggcttaaggacatgcttgtggatgccaagttgacaaggggtagacttgtggatttaatcttaggtgccagcttgactggatgaaggaatgcccagagccctggtaaagcattatttggggtgtgtctgtggggtgtgttccaggggagatgagtgtgagtctgagtggactaggtggggaagatctgtcctcagtgttggtctatgttatccaatcagctgggggcccagagagaacaaatacagaaggcaaattggtctctttctgggagttgagacagattttcatctgctgcctttgacatcagaactccacgttctccagccttgggactccatgacgtaacaccagcagacccctgggtaagttataccg

SEQ ID NO: 88932 - DNA, 333 bp, Homo sapiens
catgatgttttgatacaaatatacatagtgaaatgattactacaggcaagcaaattaaaatatccattaccacgatagtactttgtgtatgtgtgtctggtgagcacctaaaatctacactttcagcaaatttttagtgtacaatataattatagtcaccatgctgtacatgaaatctctagacctgttcatcttgtataattgcaagtttgtgtatcctttgacctacctctccccatttcctgatccttcccactctggaaaccaccattcttctctgtttctatgtatttgacatgttttagattgcacaaataaataagatcatgcagt

SEQ ID NO: 88933 - DNA, 448 bp, Homo sapiens
caaaaggttagggggtgggaggaatggagagttactgtttaatgggtatagaatttcagttttaacaaaataaaaagagttcgccaggggtgcaaggcagacctgagagtgaccaggccagacggcatagagatggggctcaagggacaggtgttgggtgtttgtatcttgtatcttggttttttgccaggctaggggacaaccactcattgcgggatgtcttaatcatcttaaaaaagaacgcagtagctcgtgcccgtaatccccgcactttgggaggccgagatggcagacggagttgcgttcactcagtgctcaatggtgcccaggctggagtgcagtggcgtgatctcggctcgctacaacccccacctcccagctgcctgccttggccccccaaagtgccgagattgcagcctctgcccggccgccaccccgtcgggtgaag

SEQ ID NO: 88934 - DNA, 239 bp, Homo sapiens
tcagactaagagaatcaacccactgaccaggcctctgctaagcacctatgaagatgttgccatacaacccaactaaatggtcatggggaaatcagacaataaaaagacatggatgcttgtcagcacaggaaaaggaaacagcagagtgaaaagacaactcacagaatgggagaaaatgtctgcaaactgcccatctgacaagggactaagaaccagaatatacaaggagctcaaataac

SEQ ID NO: 88935 - DNA, 249 bp, Homo sapiens
acagatctggtggcatttcttgtctggtggcattggtaactaagatacagaggaatttcttgccaggtgatataacacagatgatctgtaaactcaaaattggcagttggcgcttcttttacaatacagctgcaaaaatggaaatgcattcagaggtcattgtttctatcaaatttccaaatgggttttaggaatgtgaacctcacctatatatctctctgccttcatttttcagattatgtttcagtg

SEQ ID NO: 88936 - DNA, 243 bp, Homo sapiens
caataatgagtaatgagatggaatcggtaatgagtctcctatcaaagagaagcccagggcccgatgttgtcactgccgaattctaccacaacttcaaggaagaactaataccaattcttcccaaattattccacaaaatcgaaggagagagaattcctccaaactcattctacaaggccaacattatcatgataccaaactacacgggaggctgaggcaggagaatcgcttgaacctgggagg

SEQ ID NO: 88937 - DNA, 643 bp, Homo sapiens
aattccctcattaaaaaattttcccatctgccccttccttgcttacaccttggtttaaacagtgatgtgtataggctcaacaaaggtttactcatggtatgaatagtgggtttatttttaaaatttcatattcctttatctcaaaatggaaccaagaaaaagaaaatattcacaaaagatttgcctgggagcttttaacagatcattccctaagccattgcaaatttgcagcaagaaaccagaaagctatttaatgtgactggcaaaacaatttagttgcaaggagaaaggaggcaacccagagcaggggctcaaagcctacctctactctgtgaacttcctgcctcttcggtcttcctctgccctgcccaggagcttttgtgagttccacccaagagggagttgttggacagtgtgtggagagcaagtgtctttcacaaagcctggacctcataaaactcatcctaccagtgatatccatgatgtcttttttcacctcactacttatagggcttttagttgaagggtgatggtgaatcataaaaagaaaatttgtctcgaaataggtgtagaattacatgtctgccgataaaatcttaacgtgggtttaaaaaaatttttttgacactaatgaagtaaaacc

SEQ ID NO: 88938 - DNA, 379 bp, Homo sapiens
ctctctctctctctctctctctctctctctctctctctctctctcctcgaaaggtatgatggttttattcgtatgttctatttaccgaggcaaggaattatacctggcctactttagattggctgcaggaagagatgaagccaatagcactttgccctgtttcttggcttggacttgtagtaagagacctcggctgggtgtggtggctcatgcctgtaatgccaccagcactttgggaggccaagatgggtggatcacctgaggtcaggagtctgagaccagcctggccgatatggtaaaaccccatctctactaaaaatacaaaaagtagctgggtgtggtggcgggcgcctgtaatcccagctacttgggaggctga

SEQ ID NO: 88939 - DNA, 231 bp, Homo sapiens
cgaggatgaaaaacaaaggccttctaagacctacaggaaactaaggacctggagcgtttcaaaacccaatccacccccacccttaatgaattactccttgttagcgaaaaagctgttcgccagctgcaagaacacaccgaaagggtcaaaatacttaagtgtgcggcacctgcgaactaagcggcttccgaaaggtcctccgcccggggcgcttcccggagaccccgcccc

SEQ ID NO: 88940 - DNA, 270 bp, Homo sapiens
gaagaatctcaacatacagtcctcagcagctttagcatgggcaacaaattaagtctctgtaaaaggcccaaaggacagggtttggtgagattctggagagctggaaacatggaggttgacaggaatgtaaagaagaactcatttacatgccaggagggtggaacaccccaattccatgaggataactgctcctgtactccagacctcaccccatgtgtctcttcatctggctggttatttgtcctttaagatctccttactcaaccagta

SEQ ID NO: 88941 - DNA, 883 bp, Homo sapiens
tgcgggtgaaacaacaggaatacatggaatagaggaatctgagcaaagactaactcaaagatggtggtgtataacttatagaactcccattctgtgttgggcgcataaatgatctttgtagataccatttcatttactcaaataaccctgcgagccaggcactgttatccctgtgatgaaactgaggctcagagaggttaagacacttgccaaggattacagagctagtaagtggcagaactgggctttaaacccaggaagctagattccaaagtcttgtgttcttaactactaagctacactgttgatcacccttggagtcgtgggttaggagaaaaggaagggaaacaataaggtgggagaagatgaaggacttagggctcaaagctgatgcttcagtgaggtgggaaaacctgtgctgtggggttttcctcagattacacacacgtgcacacgtgtttatatcaggtgctgaaaaaaagataattaatttagatatttaccaggaattctttcagaagcatttttaatgagtcatatttgcactgcacaattctttttgcttcatttttatatagttgaaggcagtaaggaattcttgtacaagtaaacatcttttccttttgtacccctcatcactgcgaatttgatagaacccttagtaaatgaccaggttgttttttacacttttttttctctcccacaacgtaacatgggtttggcaagctttaaaaaatgttagtatgtttgtatccactagtatacctctgaccatttaataggagatccctgccaattagagctagtgatgttttgttctaatttggagagacagggtgtgtctgtctttaaattctctgtcagttttcctttttgtaaaaaa

SEQ ID NO: 88942 - DNA, 553 bp, Homo sapiens
  misc_feature (310)..(310): n is a, c, g, or t
ttttccacagggggcacgggttgccgctggactcgttaaacgggttgttgtgcgtgccactccgtcagcacccctcctctgctcagcctgcagaaagacttcacgctctggacatctttactctggccagtaaggtctagcagtgcttggccttagactcctgtcccaccacatcacatatgaccctctccctggtagataatcccaaggtttctgagtcagtagttctggggtcaggtataaaaatctgccctcctatcacattcccgggtgatgtgatgctactgttctggggaacacactttgaganaccactggcatagccatagcttgacgtaacttgatgttttttctgttacgactctttactcacttttcgcttccaggacatgcctggacatgggctgcctaacccaattttgcaaaagctggggttatctccattttatagaaacaattaatgatcccacttactcttttaaaattaatattgaactctccatgaagcccataaacaccaaataagatgaacccgaaaagatcacaccaaagc

SEQ ID NO: 88943 - DNA, 202 bp, Homo sapiens
cctagctgtgcgaccttgagggactcatttaaacctctccagaccttcattttctcatctgtaaagtgacaatgatggtacctaatgcacacaggtatagggcaaagtgaagaaattgacatatgctaggtgcccaggccagtttcagcatacagcaggtgctcagtaaacgctatcaggctggagtcatgatgtctaaagg

SEQ ID NO: 88944 - DNA, 373 bp, Homo sapiens
gcgaggaggcagctccgaatttatagtgaggggcattaaattattgcatgtacctaaaaagtgtacatctattgtgtatcaataaaaataaatttaaagaagtaaaaaatggacaaagcctacatgattgtctaaaaaaatttttaaaaactattggacaaaattcaacactttttcatgctaacactcaacaaactaggaataggaacttcctcaaactgtgaagtttatttatgaaaaacttaactaatatcacacataataacggaagacaacgtttttatgtctaagatcaggaacaagacaaaatgtctagtcttcccatttctatttaactttgtactaaaggttctagtgagggcaattggacaag

SEQ ID NO: 88945 - DNA, 289 bp, Homo sapiens
cgtaaggggagttgagtcgtcatttaccatttctggaagcagctcatctcacacagctcacagcagaatctggagctactgcttcatgttccagttcctggccttgacctgtcacctcttctcccgagagcagggggccttacaggtgtcagtgttctgtgtggagcctgggcttggtgccgcatcacctatgcctgtctgtcttctgagcactcattctgggtcagacactgagctcgaggcagggtgcgcaggtgagccaggcggggagtgcagatgcagggaatgg

SEQ ID NO: 88946 - DNA, 233 bp, Homo sapiens
tgtgagcgtgaccgtgtgtgtgtaggtccatgagtgtgagactgtgagtgtatgggactgtgagtgtaagagtgtgggagtgtgtgggtgggtgtgtgaatgtgagtgttgtgagtgtgaaagtgaggtgtgtgggtgagagtttgggtataggtatgtcagtgtgtgaggatgagtgtgagtgtgagagtatgtgggtacgtgaacgatttttttttttttctgagactaag

SEQ ID NO: 88947 - DNA, 500 bp, Homo sapiens
aaactggctgaacctggaaattctgcatttattcaataaatattaagtgaacgtctacaatatactagtcagtactctaggcactaggaaagggccataagcaaaaagcacaaaaatcttgttttcttggagacaacatctacctcctgtaacttctccgactggcccgcctggcttctttggacctccgtctggcttttatataacacctcctccacggaatattgtcctttgagattctgcagatcgctgtggtgtacctcccctctccacgcccctttcctccatcctaaacaagcagccttaattatttcaaggagtaagcaaggatgcggaaacaggagcgaaaactggactgggtggggtgaaggcgggtgctaagacgccagggctgaaaaagaaatcaacagaaccgctccgactccgggccaacgtcaagacgggcgggtccgaatcaggtgtgtcacctgacacctctcccgggaagggccatcgtcccc

SEQ ID NO: 88948 - DNA, 630 bp, Homo sapiens
aatggagagaccagcagttatggggcagttaaacatgtactaaatggtagtcgctgtgctcagcacaacatgagttccagggactcagcactgggcctcctctcgtcctcagtttcttattctatgccctctgaagcaggttcagaatcttctagacagacagaattaatgaataaaacaatgaattgtcacacatagaacttttaatgtgcaggacctggacaacataaggggttaaaaatcaagcccattgtaataacagctccttgctgttgaatatttacttcttctatttgatccctaaacagtatgctgtgagtatcatagaatatcgcattcccttcctcagtgaatttttttaaatgtctgcttcttaaggatgaaatatttgtaaagttggaggaactactcaaagccctattatttcgcatgtccccaagctccacctctgataaattttttgtaccggtaaagacagcatgtgatttgtaaaatttgtacccatagtaattaaaaatatgacctttatccagatcctgttgcagaggcacttatgaattcctctaaagtacactctcccgctgttattgttgttagaaacatgtttccactggttgacttttcaaagat

SEQ ID NO: 88949 - DNA, 243 bp, Homo sapiens
ttcgctccccccggtctgtctctgtctctcctcctccctcctcctgctccgggcggagcccggcatgggggggccggcgcccggcaggccagtggatccgggacccagggagggccgccccccgggcctggtggcactgagcagggccccccagcccccacctcctgccccacgagatgaacctcctctaccgaaaaaccaagctggagtggaggcagcacaaggaagaggaggccaagagga

SEQ ID NO: 88950 - DNA, 496 bp, Homo sapiens
ctgacatgctgtgaccacaactctcacagcaattttgtaaagcagagttttcttaagctgtgttgtgaaacagacacctttcataatctgaggaaagccttggaacactgttgtggtagagactgctaattgctcttcaatttccattctgtgcatttttagctggccatgacatatccagattaaacctgtatcacccaacctccactgcaggtatgtttggtcatgcaaactcaggggtctagtaggcctggatttatgcaaaagtggcaagagcaacttctaggaagtatccttaaactaaaaggatgtcttaaaagactgtctctttctctctctctccttatttcctgcagaatgtttggaatactatgtgatgactggagatggataagccatttccaaacacaaggtggacgatacatactgaagatggcagagtgacaagataaaaggatcatgggtcccagatgatcacagagctagctgccatatc

SEQ ID NO: 88951 - DNA, 400 bp, Homo sapiens
tagcattagccattatccttcaaatgggttgcctcctcaaagtggcccttttgcagaaggattgcatcaacatttatatttttttccctaaagtactttgttacgcaggtgagcttgggtgatgtaagttacaattaactccttcatctcctatcctggttgctgccattcttctctatttttggccagggtgtggatattggtggaggagactagacttctcttagcccgtgtgagaggtagacattgagatccttctgaaatgcatccagccattcttgctttcttcactgtcaagataactttcagcacattattattccatttaagcgaggataccatattcctaaagggtgtttcagaacccacacactggaagcaataagaaaccctgctgcaa

SEQ ID NO: 88952 - DNA, 770 bp, Homo sapiens
tgcaagtcagcccaacacagcacgtcgggtgtgcatggcctgcgcccggattgggcagcgggctgggggctgtgaacacagcgctgcgttcatctattatggtctgtccttctaagaagtccctaatttggctgcgaggattaggacatagttcccaagcagggcccacgctggcagggggcccaggagctgcggaggaaatgggtctaagcgaagagaccatctgttcgctccaggtaaagctgtgattggcaggcgactgagccagaactgcccgctggtggggccctccctccgtggcctctaacagatatacaagtaaacaatccgccagccacttatgaccaccgcgggtggcagtcccgggagaggaggcaagctaatcaaacattcaaggggggaacacaacagaatctctggcgcttgggcaaaacaatgttttgctgaagtacagccaggaagggggaaggtttgaatggaagctgatgagccagttcctcaacctctccttttctctctggaaacgtgttaacattttaatcatgttgctgagtatctgctgctggatctattaactggcccctgcactggttttaatctatctgttttttggcccagggttcctgtggagctccttgaagtctctaaatgatttgcagcggtctgtgtctcttcactacacagatcctggtctaaacatgctattccgcagtaaggtattagcaaacaaacgacttcaaccattgcttccctttttttttggtctccaa

SEQ ID NO: 88953 - DNA, 192 bp, Homo sapiens
caccatttacttttgaatactattccccaccaaaagaaaccaagcctccttagagaaatggctgattccaggtctgggactagcaaagtacaaggtaagttgaaacatctgtgccagaaagtaagaaagtgatcaaaaagacatgtcaaaggggctcaggcactgatttgaaatagacaccactggcctaaa

SEQ ID NO: 88954 - DNA, 5723 bp, Homo sapiens
  misc_feature (1294)..(1294): n is a, c, g, or t
  misc_feature (2926)..(2926): n is a, c, g, or t
  misc_feature (2928)..(2928): n is a, c, g, or t
  misc_feature (4292)..(4292): n is a, c, g, or t
cgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgancctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcaggtnangtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatganatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 88955 - DNA, 2495 bp, Homo sapiens
  misc_feature (2034)..(2034): n is a, c, g, or t
  misc_feature (2495)..(2495): n is a, c, g, or t
agcattttccacgtgattatcaactttacagccatcatttcaatgtctgtactattccacatggtggatgaactagagtctactcatcttttattgttgggacatttaggctttttgcaaataaaaatatttatcatagcagttccttccctcccctgatggcctcataagcctgtggtcctaggacttgactctttcccaaattagggtgcccacgcttccttattccctgaccacattcttccagcaaaccctcctggagctgagtgataggcactcatggtgggaggccccatttaacaccatccatgcagcactgatttgttataggctgctgtggggggagggggtctccaaggaaacagttgaggaaacagagagtgaggtgagcaggcagctaaatacagaaactgttaagggcatcagaaacacccatgggcatgtggacagctgtagaaatagggctgcaagacacctcagctagaatctaatgacctgagagcaccaggaaaagagaagggagttgacagtgtatgcagctaggaacacatccccgtcgggggtctgctctgaggaccctctataaccctaaagcagacagtacctctcccagctcagtatgatgtgctctatgattaatctaacatgaggcgactgtgttctccatcaaaggagagactgttcctgtgtgtgtgtgttgaggggtgaggggaggggggaacaccagggagacctttaaggatggggtggcatttgagcaggacctcgaaagatgaggaggcttttgacaaagggagtccagaggcagaggacagaacatagaactagatgaagagcccttgagggcagggacggtggacctccccctccctcccagatgctggctcaggcctggtggacactggcaaatgtcgttttgaatgagtgcccccggggggagaggtggcagcatgtgggcggtggggcatttgttggggggggcggtgagtcttcaccactgctgctcttgcccctcaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggtaagtggaggcttcaaggcaggagagcggaacccgcttctaaggctctggatcttggagcttgtgaatcttgtgactccatcctaggtggttttattatacatcactctctagctcatcctcacagtgatagtgaaccatgcatttcacagatgaggagactggccttagagaggttcagcacctggcccaggccaacaactaggccctgttaaggcagagcctagaaccctgcagtcccaagtgctatagctttgagtggggatttggtccaaatgaccctgtggtctctcctgccccgaaggccactgctagtaaccaatcatgaggtaagatgtggggaagggagttgctaaggtctgctctagtgatatcagagcagggaggcccaagtcctggaagctctggcccctgcaattccctgcctcccctaccttcttctccatcccctgaaactccagagactacacagatatggttggactggaggtctctgccagttctgacctttggtgaccttagaggtgagatttctggcttgagtctgagattctaagatggcggcagtcgagattattgttattggtgtgcttaccacattccaggctctatgtaaaatgctttatatgcttaacttccattaactgttaagggaaccctgtgaagaaggcactttagttcttctccctttgccgatgaggaaactgaggtccagagaggttaagtgacttgcctaacgccattcactgaataagggtcaagctagagctggaactcaggtccatccagtttcctgcctctctacagtccagattgcctgttcacagnctgtgggtcaaggttctattatctggcctggccaggcagggacagaggaagccccaggctggacctgatagttgtctttctgtttgtccacccaggaaagctgtggagtcactgtgtgtgacgggaaggtccacatccttggcgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccagctgcagtctgccctgcctggagatgn

SEQ ID NO: 88956 - DNA, 1280 bp, Homo sapiens
gggcaacagagcgagactttgtctcaaaaaaaaaaaaaaaagtcaattatctttgtaagctacatcccgaattcagaaacaaagatgcttcttagaatcaattaagtggggtggtaaagtctcaatactagctattattattaagcatcagcttggtgccaggtattttacagctgtaaccatgcaggttaaggtctcatccccgctaaatgagaggaaaccggctcagggaggtacagcaactgggtggaggctgcccaggtggtggcagcactgggctcgggggtcagtttggtcctgaaactgggttggggacagggatagtttccagctcaaagactgtaaggactgaagcgatgaggccgagggccctaaggccctggcacccggctccccggcccatgtcctcacttgcagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggaaagctgtggagtcactgtgtgtgacgggaaggtccacatccttggcgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccaaatagaaaaattttgttatttatatgttgaaaaaaaatggtttcaatttttttatttattttaatggttcttaccttttaggagagggaccgtgtccttatttctcctttaaaaaaatccttgtgggggtcccagtgtactatttt

SEQ ID NO: 88957 - DNA, 1209 bp, Homo sapiens
ttctcgagggccgcctgcgcgccgccaacagcctagcgctgcgccgcgtggccgccgccttctcgctggccccgctggccgagcgctgcggccgcgtcctgcgtcaggccttcgccgaggtggcgcgccacgccgacttcctggagctggcgcctgacgaggtggtggcgctgctggcggaccccgcgctgggcgtggcgcgcgaggaggccgtgtttgaagcggccatgcgctgggtgcgccacgacgcgccggcccgccgcggccagctgcgacgcctgctggagcacgtgcgcctgccgctactggcgcccgcttacttcctggagaaggtggaggcggacgagctgctgcaggcctgcggcgagtgccgcccgctgctgctcgaggctcgcgcctgcttcatcctgggccgcgaggccggtgcgctgcggacccggccgcggagattcatggacctagctgaagtgatcgtggtcatcggcggttgcgaccgcaaaggtctcctgaagctgcccttcgccgatgcctaccatccagagagccagcggtggaccccactgcccagcctgcccggctacactcgctcagaattcgccgcctgtgctctccgcaatgacgtctacgtctccggaggccacatcaacagtcatgatgtgtggatgtttagctcccatctgcacacctggatcaaggtagcctctctgcacaagggcaggtggaggcacaagatggcagttgtgcaggggcagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgggcgtgggcctcaggcgcgagagggcgttgaaggctggggtgcccactgtgtgccaggcgcagaattgggcgtttccatgcccttgtccatttattcacttaatcccatcaaacagcccagaccagtcacctccatgtttcagggaaggaaatgagcagaaaaatgaccccaaggtcacacagtgggtcagcagcacactgggactcaaatgtttgggctggtgccatgtaagtttcatacattttaaaaattgagggcaagata

SEQ ID NO: 88958 - DNA, 902 bp, Homo sapiens
ttctcgagggccgcctgcgcgccgccaacagcctagcgctgcgccgcgtggccgccgccttctcgctggccccgctggccgagcgctgcggccgcgtcctgcgtcaggccttcgccgaggtggcgcgccacgccgacttcctggagctggcgcctgacgaggtggtggcgctgctggcggaccccgcgctgggcgtggcgcgcgaggaggccgtgtttgaagcggccatgcgctgggtgcgccacgacgcgccggcccgccgcggccagctgcgacgcctgctggagcacgtgcgcctgccgctactggcgcccgcttacttcctggagaaggtggaggcggacgagctgctgcaggcctgcggcgagtgccgcccgctgctgctcgaggctcgcgcctgcttcatcctgggccgcgaggccggtgcgctgcggacccggccgcggagattcatggacctagctgaagtgatcgtggtcatcggcggttgcgaccgcaaaggtctcctgaagctgcccttcgccgatgcctaccatccagagagccagcggtggaccccactgcccagcctgcccggctacactcgctcagaattcgccgcctgtgctctccgcaatgacgtctacgtctccggtgagggcggagccgcaacgggagctcacacgggattgactagtagcctccgcactccaccccctttgcttttccctccaatcgggagagaggggcgggatgttttctgataacctacagttattggctgaagtgagcagggctaactacgcgtgtgacccgccctttattcaggaatgttaacttcaatacatatgattactttttgttctgaaccggcttcctaaggaagtcaattcgtattagtattaataatcacttcaactagc

SEQ ID NO: 88959 - DNA, 1615 bp, Homo sapiens
ttctcgagggccgcctgcgcgccgccaacagcctagcgctgcgccgcgtggccgccgccttctcgctggccccgctggccgagcgctgcggccgcgtcctgcgtcaggccttcgccgaggtggcgcgccacgccgacttcctggagctggcgcctgacgaggtggtggcgctgctggcggaccccgcgctgggcgtggcgcgcgaggaggccgtgtttgaagcggccatgcgctgggtgcgccacgacgcgccggcccgccgcggccagctgcgacgcctgctggagcacgtgcgcctgccgctactggcgcccgcttacttcctggagaaggtggaggcggacgagctgctgcaggcctgcggcgagtgccgcccgctgctgctcgaggctcgcgcctgcttcatcctgggccgcgaggccggtgcgctgcggacccggccgcggagattcatggacctagctgaagtgatcgtggtcatcggcggttgcgaccgcaaaggtctcctgaagctgcccttcgccgatgcctaccatccagagagccagcggtggaccccactgcccagcctgcccggctacactcgctcagaattcgccgcctgtgctctccgcaatgacgtctacgtctccggaggccacatcaacagtcatgatgtgtggatgtttagctcccatctgcacacctggatcaaggtagcctctctgcacaagggcaggtggaggcacaagatggcagttgtgcaggggcagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggaaagctgtggagtcactgtgtgtgacgggaaggtccacatccttggcgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccaaatagaaaaattttgttatttatatgttgaaaaaaaatggtttcaatttttttatttattttaatggttcttaccttttaggagagggaccgtgtccttatttctcctttaaaaaaatccttgtgggggtcccagtgtactatttt

SEQ ID NO: 88960 - DNA, 1220 bp, Homo sapiens
gagggtcgtaactcagacattcccaccacttattcaaagcacactgggtcacaggtccagagtcttacaccagctcaagaagtcctcctgctgccttcccttaacccttcctttggatctgggggccctagtttctagctctttgggggtgcttgggatagcaagagagccgatgggcaacagctgcttctctctccctaggaggccacatcaacagtcatgatgtgtggatgtttagctcccatctgcacacctggatcaaggtagcctctctgcacaagggcaggtggaggcacaagatggcagttgtgcaggggcaggtaggcacgagctgcagcggctgccctgggacacaagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggaaagctgtggagtcactgtgtgtgacgggaaggtccacatccttggcgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccaaatagaaaaattttgttatttatatgttgaaaaaaaatggtttcaatttttttatttattttaatggttcttaccttttaggagagggaccgtgtccttatttctcctttaaaaaaatccttgtgggggtcccagtgtactatttt

SEQ ID NO: 88961 - DNA, 575 bp, Homo sapiens
gaataccctttagaatgatccaatttttcattcaggcacttgaagttcattaaatgaatgctggagaaactgttttctcattgacgtacttgctttaatgaaatgagaaagtaagaagtgcctgaatattggtggtggttctcaaacccaaggaaatctaggggtttgtggagatccagaatctcctctctcctcaccacttttatggcctttatctaattttacttttcagccacgtttgatgtagctgacttccatctcgaaacactctcttctgattttccctttgattgcactatccactcctttttccatgtcctcgaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttgtctccgtaagtgaactgcaaactcagttttcaaagtgcccatctgaccactccactctgatgtctaacatgtgctcgcttacatgtggccagaagagag

SEQ ID NO: 88962 - DNA, 351 bp, Homo sapiens
gaggttcctctccaacacccttttcccttcattattctgaaggcccttctatttgttgtctcttccttgtttgctgaatactcctggtataagaaacctctatttgggcagatgataaagaagataatacccaaataaatatcaagaactaattctggatagtaatcatgacacttgaaaaataatcacttgaagatattcagctacaaattatattaaaataagtgtaactttctatatctgcagtacttttctctacccttgaccagagagatctttcttaaaaagaaggcttgccacatgacctctgctttacatcctttggtgatgccttttgtgttcatggcccac

SEQ ID NO: 88963 - DNA, 460 bp, Homo sapiens
gatctagagagaatcctgtatctaacaattttaatttttttccctttatgctgttattccttacctagagaaacaatttccctccaaagttcctttgaggggtctgtttaggccaggccaacacaagtgacctatgtggattttagcatcctttttttgaaatttgaggttttatgaagcttgagtttttctggatatttttagtaatttgctggtgtgtacttagctcagatacttgattgcaactgtgttgggtcaactatttctaatgggacttttccatttgcatgtacagtcactggaaactgctgggcagagaaactctaaaaggtagttggggcacactttttccacctgtcagattggtgaagaattggtgaggctgtggggaaaatggcattctcccacttttgatggatatgtatccaaataaaagtcattcccatgctttctttcatcc

SEQ ID NO: 88964 - DNA, 301 bp, Homo sapiens
taagcatggggtcttgctatgttgcctaggctggtctcaaactcctgggctcaagtgatcctcatgcctcagcctcccaaagtgctgggattacatgtgtaggccaccacacccagccttatatatatatttctaattttgccttagccatgcccttaaaaactaattctactttcaactagttttttttttttccaccttcagtctgtagtattgttcacattttgaaaacaatacctacagtaacctgtgaggtaggacatgatagtgttttattggaccccttttactttatgaattg

SEQ ID NO: 88965 - DNA, 369 bp, Homo sapiens
aacaattctggcttgactcaagactgaaatataacagccaaacaggcacttcgtaaatgaagaaacatgtatgaccaataaacataagatgcgtaagcttattaataaccaagaaaattaaaattaaaatgagattatttcacacctactaaattggcaaaaatgttaaagtctgacaatattaaatatcagtgagaatatgaaacaacagagacacttaatgttggtgagggtgttaactggtacagccacttttgcaaacagaaggcattaagatgctggagagcagtgagcttgcctcaagatctgttgtggccagcagagaggaccccatttaaagaccaccaagtggctaagactcaggtttgg

SEQ ID NO: 88966 - DNA, 439 bp, Homo sapiens
ctggtcttgatctcctgggattacaggtgtgagccaccgcacccggctatcatctcctgttttcgcaagcaagaactgaaaatacatttacacatttattatctattgtaccacgtggacctttcttttgctgccatatctatgggatttggtattgttacaaacttctttcaccattttcagcctcaccctaacttgttcttcctcctcttcatttctactccaaaagcttgcattcatcttcctttgatcagatatcttctgatgattctccattgtctaaaaaatgaaatttcttttaatctgactccagccttttcgtttgttgccatcctctattcagtatgcccccagctgaatttcactatttgccattcccagcttcccagtcccaacccggcctagacttctcacactcactcttcccagcttgctcaga

SEQ ID NO: 88967 - DNA, 430 bp, Homo sapiens
cctcttttctggaaagtgcattctctcacacataccaaaacggaaggtcacttatctctatgtcatcatatggagatttaacagaaaaaacttaaaaggacatgcacacaagaatcctatattagaaaaaccaggaataggacatgcagtagccaaaggcctatcttggtttggcggtgtccccttcttaagaaaatcagtgcttaatatttctatcaaaattattggggaaaccagccccacactacccggtgggtaccccgagtccagcagaaacaaaggagttagaaagagacagagtaagagtttaaaaggcgcgtccagagctctttagctccacctaatttattggtttacaagctctttgttcttagggcagatgggagggggaggaagggatgaggaaaaggattaatcagtgaaggagaac

SEQ ID NO: 88968 - DNA, 369 bp, Homo sapiens
tcaaagctcaactcactatagcgtgatttacttttcttactgcaaggaaacaagcatttcagtcttaaagagacagcatgccagtggtcctgttctgtgggttccacccgggaaggcattaccaagggcagtcagagcccaggcaaaaatgctgagaaggcgtgaatggtgcaacagactctggccatagacatgtacattaaagatggctttccagatggatctcctcctcgccatccttataggaccctgatagggttagaaatggagatgtaccccagagctcaccattatcagggcagcagttaagatgctatttatttgaagccagctaacctctcctaagtgctacagatagcggccatttat

SEQ ID NO: 88969 - DNA, 445 bp, Homo sapiens
gacagagagtcggaaaaggttttcattgctttctctctgtactgttcacgtggtagctactctgaggttaagtcgtaggtcgaagttcaggttgcctgggagtgaacctagtcaaacaaccccaaggtgatcagggtttgcttaaacctgtagactccaaagctcaaagttgtatttggccattttgtaactatgctcttttagaaagaagatcggacattttatttctgtccctcctttctatgttaacttaggagagcctgcgttgatttctagctgtcttctggaagtacctctgtctgcttatggataagtgtagttctgtgaaataagacatcagcacagaggacacactgtgaatggggcttggtatgactgggtgatgttggaggcaatggaacacattggtcaagacatgtacagtggagtgagggaagtgggttca

SEQ ID NO: 88970 - DNA, 293 bp, Homo sapiens
gtgaaatctgtgaatatactaaaaaccattgaattgtaggctttaaatgagtgaattgtgtaatatgtgaattgtatcttaataaaactaagtgaagcctgaacgcccacttttgaggacagcggacgaaacacagggtatgacaggagtaacagagctaaagccctgcctcgtgggctgcacttgacagtaaggaaatgaagcgccatagccggagatcctatgttagtttcccataagccaccctctttggagggtcaagtcacagcatataggatcaggaaagggtcttt

SEQ ID NO: 88971 - DNA, 362 bp, Homo sapiens
aaagaaaaaaaaaagtgatgaaaacattagtcttgttattctgagggctggtgtgtgtgtatgagagagagatgtggaatgaagtaaatgaataacgatgtgatattctaattttaccacctgtgatatcctggagaagcagaattctcctggaataaagaagacatagatataagatagaagaaggtcagagacatatatttttgaattagaagtgccagtgtgaactcaaaaggtattttatatttaaatacatgtaggtatatgtaagtgcatgtgcatatgtacatgtacacacacgtgcacatcaacactaggcttcctacgtctgtttgctgaaaagatctagaaataataaccaa

SEQ ID NO: 88972 - DNA, 137 bp, Homo sapiens
cacaggtggagatctgcccaaagcctttggagtccagccctcacactcctgtgccatggatgtgggacaaggattccaaaaggatgattttggagctgtaggattgaatgactggcctactgcgttttggacattca

SEQ ID NO: 88973 - DNA, 813 bp, Homo sapiens
ctcaaatcctccaccctcataccacagcctaactcttcaagggcttgcagtgaaatctgtttctgaacatttcacatgagaggaaagcagagaataaccactagacatttgcctgaaaaatcctttctgcctctcctccttttatctttcctagacacagacaccttatcaggatgtctttgggatgaggttcctttatggaaactttgcagggtgatatgtcttcagtacaccctcctatcttttccagattttgagttttagaactgcctgtagctgacccaagacccccacaattgccatgtctcttggagggtctagtgggtatctgtgcctaggggagtggggcctcccaagggagcagctgaatgactagtggtggaggagatgcctggtatacttttcatctagatacccagttcgtgggtgctcaccttctctctcctaacttcagtttcccattaattggagacacatggccaatcagctaattggatgttgcctattgaggaaaaacagaaatgattcctgtcctttggattgtctcaactgtgaagagagaaatatcccaaaagacaaggaaaggccaccccaacaaggttgtatttagctgtcctacagggaggtggtcaccagaatgcagttgtggaacaaatatatgtgagttgaccacatggaggaactgggaggaggtgtagaactggaaactctgttgagtttgagtaaagtttacttctgttatgagaatgttaaatctataatcaaaatgcatgctaaggtaacatatcaatataagaactcactataaccggc

SEQ ID NO: 88974 - DNA, 838 bp, Homo sapiens
ctcaaatcctccaccctcataccacagcctaactcttcaagggcttgcagtgaaatctgtttctgaacatttcacatgagaggaaagcagagaataaccactagacatttgcctgaaaaatcctttctgcctctcctccttttatctttcctagacacagacaccttatcaggatgtctttgggatgaggttcctttatggaaactttgcagggtgatatgtcttcagtacaccctcctatcttttccagattttgagttttagaactgcctgtagctgacccaagacccccacaattgccatgtctcttggagggtctagtgggtatctgtgcctaggggagtggggcctcccaagggagcagctgaatgactagtggtggaggagatgcctggtatacttttcatctagatacccagttcgtgggtgctcaccttctctctcctaacttcagtttcccattaattggagacacatggccaatcagctaattggatgttgcctattgaggaaaaacagaaatgattcctgtcctttggattgtctcaactgtgaagagagaaatatcccaaaagacaaggaaaggccaccccaacaaggttgtatttagctgtcctacagggaggtggtcaccagaatgcagttgtggaacaaatatatgtgagttgaccacatggaggaactgggaggaggtgtagaactggaaactctgttgagtttgagtaaagtttacttctgttatgagaatgttaaatctataatcctagaattaattaaattattgtatatggagatgacaggtagtggattgattattctcctgtagataaccatttgt

SEQ ID NO: 88975 - DNA, 403 bp, Homo sapiens
ttatggacccatggtgagatctcaagctagtcctccatttctctgagcctcagcttccccatttgtcaaatggggcctacctcgtaggatgctgtgaggatgttgtgggtgatgcacgtagcccagccctggtgtgtggtgtccattgtcctcagtatgtcagtgacagggaagggagtgctggggctcaggcccctggcctaggccagcttagcaggaagctcaggcaaccagcatgggctgctggcccctgggcttccgccaggcagaactcacagccccctacccacccagccttccctccttgagggccaggacccagacggagcctccccaaggtgcctgcccagtggaactgaggctgttcctcgagaacgagggttgtgtgtcttcttattagcat

SEQ ID NO: 88976 - DNA, 300 bp, Homo sapiens
tctaaattgatacatacagaaattcagtgcaatcgcaataaatatctcaatagggctgttgctgctgccactgctgcttttttttcttttggataggctagttctcaaatttacatggaaaggcacagggccaagaatggcaaaggcaatcttgagaaaaagttggaagacttaacactaacatatatcaacacttattataaagctacagtgattaaattagtgggcgcaaagccagattgaccagtggcacaggatagagtccaaaagttgacctacacatacaaggtcagttgattt

SEQ ID NO: 88977 - DNA, 263 bp, Homo sapiens
gtccaggagtttgaggctagcctgagttggtctgcaaaccagctcaccagatattgggtttcaccatgtctccaaaaatattttgtgaaatttgtgaaactccatctctacaaaaacatacaaaaattaggctgggcgcggtggtgggcacctgtaatcccagctactgaggcgggagaatcgcttgaacctgggaggcggattgcactgagccaagattgcaccaagattgcaccactgcactcaagcctgggtgacagacc

SEQ ID NO: 88978 - DNA, 317 bp, Homo sapiens
cagcaactgagactcccccaactcctcaacagggaggatgggggctggatggatgccttctacctgcccagttgaaggcagtgagagtatcctagtgcctgggggaatgtgacattaaatagaaggtcacacacacacacgcacacacacacacacacaccactatgaaagatccagagagagaacacgaagaaaggaaaaagctttttttcctgccttttgaacgagtgaccccgggttttaagtagccagccctgtttgtgctaagtgctgccccaggctctgtgaagaatgcaaagatacaactgtcttctccc

SEQ ID NO: 88979 - DNA, 2048 bp, Homo sapiens
  misc_feature (38)..(38): n is a, c, g, or t
  misc_feature (59)..(59): n is a, c, g, or t
  misc_feature (80)..(80): n is a, c, g, or t
  misc_feature (103)..(103): n is a, c, g, or t
  misc_feature (119)..(119): n is a, c, g, or t
  misc_feature (163)..(163): n is a, c, g, or t
ccgcggagaccccaagacccacgcgcagaccgagcggnagccggggaggggagcgcggnccggccggccgagttcgcggncagggggcgccgggactcccctntccgcgcccgggacgncgcccgccggatcgcgccttgggatgtagcgcccgctcgccgcntcccggactctcgtcggaccctccgcccagcggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtggcgcgtgggcaacctgcgcaagagccacattgtggaggcccacgtgcgggcccagctcatcaagccctacatgacccaggagggcgagtacctgcccctggaccagcgggacctcaacgtgggctatgacatcggcctggaccgcatcttcctggtgtcgcccatcatcattgtccacgagatcgacgaggacagcccgctttatggcatgggcaaggaggagctggagtcggaggactttgagatcgtggtcatcctggagggcatggtggaggccacggccatgaccacccaggcccgcagctcctacctggccagcgagatcctgtggggccaccgctttgagcctgtggtcttcgaggagaagagccactacaaggtggactactcacgttttcacaagacctacgaggtggccggcacgccctgctgctcggcccgggagctgcaggagagtaagatcaccgtgctgcccgccccaccgccccctcccagtgccttctgctacgagaacgagctggcccttatgagccaggaggaagaggagatggaggaggaggcagctgcggcggccgcggtggccgcaggcctgggcctggaggcgggttccaaggaggaggcgggcatcatccggatgctggagttcggcagccacctggacctggagcgcatgcaggcttccctcccgctggacaacatctcctaccgcagggagtctgccatctgacctccaggcccggccctcaccactgcccacaagagcctctgccgggggtgggatgccaggacaccccctcccacactcaggacagagccaaccctggctccgtggaccttctggaggaaggtgggggtttcaaagactgggggaccccttcctcctgactccagcacccaggcctgggaagagctcggccccgatcagcctgagttccgccagcgcctacttctggtggctctaggtccccggatccaccacccttcccccactgactcttcaaggacgtgccctctttgctctcagaaccttggggaaggtggctggactgctgggcgggggacatctcggggtttcagggtgggcagggggttagtttggggaggggggggtgcgtttcttttgcatgactgtggcctgttgctcatgactttcttttgtaaatatctataaatggagacagatggagacaccaaattcacttt

SEQ ID NO: 88980 - DNA, 1912 bp, Homo sapiens
  misc_feature (1)..(1): n is a, c, g, or t
ngagaatttcaaccagaaagaacagccagtgcaaaggcccagagacaggaataaacttggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtggcgcgtgggcaacctgcgcaagagccacattgtggaggcccacgtgcgggcccagctcatcaagccctacatgacccaggagggcgagtacctgcccctggaccagcgggacctcaacgtgggctatgacatcggcctggaccgcatcttcctggtgtcgcccatcatcattgtccacgagatcgacgaggacagcccgctttatggcatgggcaaggaggagctggagtcggaggactttgagatcgtggtcatcctggagggcatggtggaggccacggccatgaccacccaggcccgcagctcctacctggccagcgagatcctgtggggccaccgctttgagcctgtggtcttcgaggagaagagccactacaaggtggactactcacgttttcacaagacctacgaggtggccggcacgccctgctgctcggcccgggagctgcaggagagtaagatcaccgtgctgcccgccccaccgccccctcccagtgccttctgctacgagaacgagctggcccttatgagccaggaggaagaggagatggaggaggaggcagctgcggcggccgcggtggccgcaggcctgggcctggaggcgggttccaaggaggaggcgggcatcatccggatgctggagttcggcagccacctggacctggagcgcatgcaggcttccctcccgctggacaacatctcctaccgcagggagtctgccatctgacctccaggcccggccctcaccactgcccacaagagcctctgccgggggtgggatgccaggacaccccctcccacactcaggacagagccaaccctggctccgtggaccttctggaggaaggtgggggtttcaaagactgggggaccccttcctcctgactccagcacccaggcctgggaagagctcggccccgatcagcctgagttccgccagcgcctacttctggtggctctaggtccccggatccaccacccttcccccactgactcttcaaggacgtgccctctttgctctcagaaccttggggaaggtggctggactgctgggcgggggacatctcggggtttcagggtgggcagggggttagtttggggaggggggggtgcgtttcttttgcatgactgtggcctgttgctcatgactttcttttgtaaatatctataaatggagacagatggagacaccaaattcacttt

SEQ ID NO: 88981 - DNA, 1949 bp, Homo sapiens
  misc_feature (38)..(38): n is a, c, g, or t
  misc_feature (59)..(59): n is a, c, g, or t
  misc_feature (80)..(80): n is a, c, g, or t
  misc_feature (103)..(103): n is a, c, g, or t
  misc_feature (119)..(119): n is a, c, g, or t
  misc_feature (163)..(163): n is a, c, g, or t
ccgcggagaccccaagacccacgcgcagaccgagcggnagccggggaggggagcgcggnccggccggccgagttcgcggncagggggcgccgggactcccctntccgcgcccgggacgncgcccgccggatcgcgccttgggatgtagcgcccgctcgccgcntcccggactctcgtcggaccctccgcccagcggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtggcgcgtgggcaacctgcgcaagagccacattgtggaggcccacgtgcgggcccagctcatcaagccctacatgacccaggagggcgagtacctgcccctggaccagcgggacctcaacgtgggctatgacatcggcctggaccgcatcttcctggtgtcgcccatcatcattgtccacgagatcgacgaggacagcccgctttatggcatgggcaaggaggagctggagtcggaggactttgagatcgtggtcatcctggagggcatggtggaggccacggccatgaccacccaggcccgcagctcctacctggccagcgagatcctgtggggccaccgctttgagcctgtggtcttcgaggagaagagccactacaaggtggactactcacgttttcacaagacctacgaggtggccggcacgccctgctgctcggcccgggagctgcaggagagtaagatcaccgtgctgcccgccccaccgccccctcccagtgccttctgctacgagaacgagctggcccttatgagccaggaggaagaggagatggaggaggaggcagctgcggcggccgcggtggccgcaggcctgggcctggaggcgggttccaaggaggaggcgggcatcatccggatgctggagttcggcagccacctggacctggagcgcatgcaggcttccctcccgctggacaacatctcctaccgcagggagtctgccatctgacctccaggcccggccctcaccactgcccacaagagcctctgccgggggtgggatgccaggacaccccctcccacactcaggacagagccaaccctggctccgtggaccttctggaggaaggtgggggtttcaaagactgggggaccccttcctcctgactccagcacccaggcctgggaagagctcggccccgatcagcctgagttccgccagcgcctacttctggtggctctaggtccccggatccaccacccttcccccactgactcttcaaggacgtgccctctttgctctcagaaccttggggaaggtggctgtcgggctagtcgggggggctagtcgggggataacacgttggcgagctgtcgggctcgggg

SEQ ID NO: 88982 - DNA, 250 bp, Homo sapiens
tgagcatataatgggttttcaatacattttgttgattaaatgaatatatacatgtatatgcggttatacaagtgtttgtatacacacatgcctgatatattagggtgatgcttataagtaacccccaaattttcgtgactttacctaatagaagttcatttttattcatttaacactctgaagcagatgttcatagttggtaggcagttctctgtgaaataattcagagatctgtttctcttctgtttgg

SEQ ID NO: 88983 - DNA, 393 bp, Homo sapiens
tggcttggccaaggtcacacagggtgaagagcagagccagggtttggacacagatggtctggttccagcacctccagcctcaactcccacactaccaccttccaaaaggagaggagcaaggtctgtgggtgacacaagggcttcctgaaccagcagggcccaggtggcaaccaggcttggcttggtggatgccagcagaggggggcatgcccctcagcagggtatgagtgagtcagccactcagcgcatggtggttctggccctccactggggacactccccacacagcccctggagaagggtgtggccatggagtcagcctgtccattccatgagggcagggactctgttctgctcacacccaacacccgacaccatgctctgtgccgtgtt

SEQ ID NO: 88984 - DNA, 444 bp, Homo sapiens
attctcctgcctcagcctcccgagtagctgggactacaggcggccgccaccacgcctggctaatttttttgtattttatagagacagggtttcaccatgttcgtcaggctggtctcgatctcttcacctcgtgagccgcctgcctcagcctcccaaaattctgggattacaggcatgagctaccacacccagccttgtagttttactttcttatgtcattgcaatatcttgtattggtgtcatagaataaactgggaaatatgtcttcctcttttttattggcagagtttgcaggtgaaacaatggtgttaattctttaaaagtttggtaatatttccagtgaggatatctgggcctgatattttctttgtgggaagttttttggttactaatttaatgtcattacttgctgtagatctatttacatattctatttcttcttga

SEQ ID NO: 88985 - DNA, 513 bp, Homo sapiens
tcagaattacaatgcatatgaagcagaaccatggcctgcagcctgcatatatacaaagagccactgagatgtgggattgcatgcaaaaaattagtaccagaagtgggatatgccataacagataaaatacaaggcataagctttggagctgggcagtgaaaggtatggaaactgtcactacaggatagagaaatagtgacccgtgatccagcagtaacacatttagtaaaactgcccctgtgatcacttcgaaggcaggagttgcaatgaacgaatgtgtagctttaggtgacaaggtcgcaaaacagaacattgctagggggatttggttactattaggtccatttgacgaagtactacaataaagagacgagctcagaaaagagttagctggttttccaataggattgaggcgggaaaaaaagaaaattaggaaatttgggacttaacaattgcaagatacaatgatttctcatctcctataaataaagaaaaaaaatgggccagacgcag

SEQ ID NO: 88986 - DNA, 430 bp, Homo sapiens
acttttcttattgcagaccagtttgagttataatgccacatttttcatgtattaaaacagcaaatgctgggattacaggcatgagccaccgcacccggccctgctattatattctttacggttctctcttagtcaattcctcatcattctagtccccttttatgcttttataggtattccttttttctttctttcttattttgagatggagtcttgctctgttgcccaggcaggagtgcagtggtatgatcttggctcaccacaacctctctctttgggttcaagtgattctcctgcctcagcctcccaagtagctgagattacggctgcctaccaacacgcccggctaatttttgtatttttggtagagacagggttttgccatgttggccaggctgttctcaaactcctgacctcagttgatcagccc

SEQ ID NO: 88987 - DNA, 180 bp, Homo sapiens
aagaaaaagagtgggtttccagaccaagggcattgttgccagttgaaacagaggtgcagggctgccctcattccttccagcctttcatttaatacgtattctatttaatacatagggcacacatatttagaatctgacttgccttaactgccttctcaaggcgcagattggggtgtacta

SEQ ID NO: 88988 - DNA, 580 bp, Homo sapiens
ttaggagttaaagatggcaggttacaggtgaaacgccctcatggatcacactgaggctaacaatgtagactctttccaaatagaccatatccctgggaatatatgtcttgtgatgagaggatgactaaaaatacctgggaaggcccggagcagggcccagggatgcaggattttctgaaggatcccatgggattggaagaaaatgctggggccgcccatacgctgctaatgccctggaggcagaatctagtgggagggagcgaccttgctcaattaagctgctgtccctcacactggctgcgatgtgagcccagggtcaagccggactgtgctttcagagcaggcccctcaaggcccagagttatgggccgtggtaagtgtgtgtgtgctggctttgatctggttgtacctgttggccatctctatgggtctaagcatatctgggaaacagggctttcgactgtgggttgtaagttataattagactaaccaaaaggtcttggttggagactaggccctccgagtgacaccagcagtaactttggaaggaatgtcatttgcctgggtgccacagttcctc

SEQ ID NO: 88989 - DNA, 315 bp, Homo sapiens
cacactgcacttcccaaatgctcccggcactggcacagatgcacaccctcttggccatccccacctgtgctccgccactcttagtcagccattcctctcggcttccgggagtcccctccttctctaaggatctcacccccatccgtgtctctgctgtctcctaactaccgatagcaagggcactagtgcccctgtttgccggggacaggccctgtctggggccctggtgtggcatcattgttaacagagcttcttttcactctgaagtgttcagttaggacagtcacttgcacagtcccctcactggtgacacag

SEQ ID NO: 88990 - DNA, 302 bp, Homo sapiens
  misc_feature (24)..(24): n is a, c, g, or t
gcacgagggaacgccggcccgctntgtgccaccctctccccaagcccccgggaggaggcctcgccaccatgcccagagcagcacagtgagtcagagatgaagctcttgtcccacctgccccaaccctcgagccctgcttcccaggtccgcgttcccaggcagcctgccacagccagtgccagcgagagagtggatcaggcttcaggatagcccagcactgaggacatctaaaacagtcttcatttatttatttattgttcatagtgtccaaaagttggaattaaagtgaatggctgaatcaa

SEQ ID NO: 88991 - DNA, 240 bp, Homo sapiens
tcttaacatatttgctaatttcagagcaaaaatatatgtgtattaataaatcaactgtaaattgtcagtaagaaccttaatggctttaaaagttaaaatttcaggtcaagcattgtggtgtgctcctgtagtcccagctacttgggaggctgaggtgggaggatcacttggcttgaacccccaggtagagggtagaggccagtctgggtaacacagcgagaacccatctcttaaaaaaaa

SEQ ID NO: 88992 - DNA, 208 bp, Homo sapiens
gatcagagtaaaacctggagctagattgattacagagtgcaaggactaggcaccccgggattggagagcatccttgaaagcaagggttcttcatttatttataaaaatttgattgcctactagaagcccagctaagagtatgaagcaattaagacaacaatctttgctcaagaatctcctagacaatcctgattcaagcaccagaaac

SEQ ID NO: 88993 - DNA, 605 bp, Homo sapiens
  misc_feature (474)..(474): n is a, c, g, or t
  misc_feature (605)..(605): n is a, c, g, or t
acagaggaaactgatatcgggactgtctgtgcagcaagagcaacacaaatactatgacatttgaatctcaccacacccttacaagggagaggtgttctctccatttcacagatgagaaaactgagttcagacaaatcagtcacagagcttgagagcacagcccaggcccataccaaaggccacattctatctgcacagcatgctgcctacacactgcgttcagttttgttctcagttgctggaaaaatttccagcaggagtcatcaggcctgatgttggccaggcccgtggcagtgcccagccggctccccactgcctgtctctagtccccttgctttgcatctgatgctgacacacacatacgaggagcccagaggcagaaacgggactcagagcctgacgctgaggctggtgtgtggggctgcctctcccagtgctgaggctggcgtgtgggggcttcctctcccgacactnaggctggcgtgtgggggtgcttctcccgacgctgagaaaggcgcctggggcttcctctcccgacgctgaggctggcatgtggggcttcctctcccgacgctgaggctggtgcaggcatagtcgggtatccn

SEQ ID NO: 88994 - DNA, 453 bp, Homo sapiens
cgtcttgtgtcataatggaaaaaatggaaaagaataacgtctgtgttggcctcagtgagggttgggttccgcttctcaagacggttagggactgtttctctctgtttctgggctctgccatccatattgttagcattatcctaattctggctctgcattatggtgggctgttcactgtccacagcagggaatgtttggaagaactttctcagaaggcccagagggccggatgccaggagtttgagacccgcctggccaacatggtgaaactccggctctactaaaaatacacacacacaaaattagctggccgtggtggcgtgcgcctgtagtcccagctactcaggaggctgaggcgggagaatcgcttgaacccgggatgtggaggttgcggtgagctgagattgcaccattgcactccagcctggccaacagagcaagactccatctcaa

SEQ ID NO: 88995 - DNA, 354 bp, Homo sapiens
aagctttgcagtgctctctggtgaagcccctgccctggcaccgcctgccgtagcttccctctgggaagtgacttcctggtaaggtaaaaagtgtgtcaccagctgcttctgcaaaacagatgcactggcagcccaggggagtgcttgtgaggtgggaaatggcttctgactgcttaatttagcttcaaaagcacacatattttcatgattaccccccagtggtctatgcacacagacgccctcaggtgctctccaggtacagaccactggggagggtggtgtgcgcacacgcatatgtgtgtgtgtaatttttttttttttttttgagacagtcttgctctgtcacccaggctg

SEQ ID NO: 88996 - DNA, 563 bp, Homo sapiens
ttagaattaggtagagagaaaggaaatgaacaaccatgcaagaaaataaactctttgaaaagtagaaaatagaatggtggaacagaaagtgatgagtgtggggagaatagcaaagccaccttagatggggagtcagggaagacatcacaaaggaaacaacatttgaagcaggacttgaaagatcagaacaggccaaccatactcaattgggcgaaggggtttcctgccgaggaaatagcacaggtgaaggccctgaggagggatggagtttagctggtgcccctatacttcctaatgggaagtgcccagtaaagacacagctttgcacttccagcccaggcaaagcaatcagcctgcatcttcaagggttggctgcacttaagatccggggtgctgccaggatgttctttttgcagttaatttgctgcaactggcagaggttaatcatgtccacattcctcaaggcccctgccaaagctggcccttctcacagatgctggtttaaattagaggggttcttagcagcagactagatttagcagtgattaaccccaaactggtcc

SEQ ID NO: 88997 - DNA, 804 bp, Homo sapiens
agagttatgagtagtttgtatttccttttttgttaatctgtatttcattttttaggcaatgcaaatatattatttagacaacaaaatacttattagaaagaaaagacatggtgggttttttcccctttattctttgcttttctaagaggaaactttgactgcaattgcttgtgagtgatacctgtgttctggtagcttaggaagacacaatgtggttagggaaggataagaacagatggctttaataaatgtactcaaggctaatgtacccttcatagtctcaggcttcagatcagatctcttatctatgctggcaccaggatgtggttttgagttctctgctttttctacagctttagggaaatctgcatgcaggcacatctaattgtccaaaccaaaaatcacatccaggatgtgaggcagcctgggagaggtcattttgagttctgtagtctccgaagtataaaaacacataaacatgtatacatacacacattaacacccacacacttttgaaggaagatggaatggaagacaagcaccacagtgaaactttagaagaatttcccttacattcaggaaaaaaagatagagggtccattttcatcactcttattgccattgtctagaagataagccgtaataagataaaataaaaagtgtatagaacacttggaaaaaaatataaaagattggtcccattctccgatggcatgatattcaaatgaagaaccaactataaacaggttgttatgagctgaatgttaatgtgaccccaaaattcatatgctgaaatcttaaccc

SEQ ID NO: 88998 - DNA, 188 bp, Homo sapiens
agcccatgggtaggtgaggggattgcagtctctcttcagtgtgggattctgaaaagaggcaaactgatagaggctccaaccaaataactgtacccacacattgagggactgaaggtaaactcccagagaagagacaaagacaggaggtggagagcagaatagtcaggaaacaagttagtcacagactt

SEQ ID NO: 88999 - DNA, 563 bp, Homo sapiens
aaaatgttttccatcataaagttgagagacattgccctatgtcaatctttctcaagtcaatctcatggtttcaaaattagattgcaaaagaattaataatattaccataaacagaaagagggcaagttggcagctgtctcctggacaaggtgctagctggtgacatatgagaaaggctgattcagctggacagtgagacatagcttagtaagtagagctagaatccattcaggatactataagaagaaaagctagacctgagaacgagctgaaggatcagtgatacctaggagttttgccttgctgaataatctgtcctaaaacttgttctttctgtaattttaaaaattcttatttctcttataaacatttcttttaagaacttcaattatctctttatgtctaagagaaaatctttctcttgggttaatagagaaaggggttggaaaaagaaggcctactccagaatgagaggaaggtagtgaccttccagtttgagatcgggagcattggtgacacagaaatggagccctagacatgcaaccacccttacctctgttcta

SEQ ID NO: 89000 - DNA, 561 bp, Homo sapiens
agaaatttgacccctcgccatatggcagctgcagcatactggaggtgccagtgaagtgaacaggtcctttgtttctttcccagcttgaggacaggaagggcggtactgctgtagctgcaatggtagaggggctgtgggttgactctgggattttctcctcaaagaaacagacagccaccaccaacaagtgttcaggcaggggcagggcagctttactgggggcccaggtcaagacaccctgaccagtgaggaatggcaggggcagggactcatatggaaagcagcctggttacctttccataaggcaattgtgctgtgctggaggcccatgatcattcttaagctctttacttcctgttatgcctgagggcagtaggggtaagagctgcaaagcagcaaaaatggcaggcctgtcctttacctctaggagctcaatcccagggaaatgctgggatagagttcaggtggggccagggtggctgtgctggggtcccagattgggagatcctgaccagtgacaagtagcagaggcaggggcccatgtggaaaaccatatggctt

SEQ ID NO: 89001 - DNA, 372 bp, Homo sapiens
aactcagaaagggtaagtaacatggcagggtcacacggcaagtcagtggcctcatctggacccaaatctcggccatctggctcaagagcctgtgctcctgtccctcagacatgactgcctctcaaagaagaattttaaagaagtaatccctggctttatcaatcacagaaattattgatagatatcttgatgatgcatttcagtttgaagacagtgctatttgtggaagttatgaaagttcctctatataaatactaccgaaaagtccagtttctggaaaatgattgctgaaaatgatttgtatggtctctattttttttgagacttttaagtttttctgcacccaaaattcatttctaaagagaaactgta

SEQ ID NO: 89002 - DNA, 123 bp, Homo sapiens
ctgttttgctgttgataatgacttcatttgaatggaagatgatccctatagatcaaatagtagtttttaaaataatttagtaatttaatatcctttaaggtaaactgctttccctaccactct

SEQ ID NO: 89003 - DNA, 696 bp, Homo sapiens
ctagaagcaatatccgttttaagtagaggccaaacttggactgataacctcatgctctcttaccaatattgtaggcagtgagtgaggagttaacaataacaacaaaaggcctaggaaaagcaaggagaatgtgtcctatatagtcagggacagactttggagtcacactagacccaccatagttgtgtgtaaaataaagcagatttgaatcatctagtcacacaaaaaagaaacgagaagttactgcagtgagagagcaaagcagttccagatggtggaatgcttttactgtgtgtgttggtctctgaggtgctcgtgacataccattatcatactgttcctcataatgaccctcagccactaagaaatggttgagttatgcgggataatttgctaagactgtagaactaatacactatataaagactttcattactttgtttttaatctttgcaacttaaaggagtatttttcagttaccagtaacattaatttgttttactcggtgctagataaaaatgactaaatttgaatgtgcacattatttcatttgattcttaaaactaagtaggtcatagaaaggttaatggccaatggtaaaataaaggctatgagttcagactttcatgcatgtatttgattctgggtctctttctcattgttaacccaaagcttatttataaaggtcagggcctg

SEQ ID NO: 89004 - DNA, 792 bp, Homo sapiens
taaaatatgtcagaaatgaattcttattacatcatgtcaacattcttctcaagctgcagaacaatttccttaagggcaggatcctctgcccaattgactttactccccaaaataaggttctggaacacatgttgaataccagtagtaatttttatctccatctgtaggttaggtcgtatgatcttaatcctctctgagtttcccatacggtccaaatcaatcttcgtgttggtcctttccagtcgtgtattttctaaaagcttactttctgaagctggtttcaatggcaatctcttctttctaatatcaagcagtttttcctctaaatcccaagattccgtgctgtgattccattattaatttatttagccttctaatagggtggttccagtgttactccagtgagccacacttagaacgtgtcgtgctaatttttcctccaggtttttttttaagtgcagttgaaagtctcatccgtgtctaatgcaagcttttttatctcaaaagcaacttttacctcttcaatttcattttccaggtcttcaatgtttagctctcgattggcttctcctggcataattggtccgggagttatctcttcactgtgcatcaaccatggattcatattctaagagtggtggtcggcatgggctctcagcctgaggagcagggtcatgcggtcctcgctgcacgccgcctgggcgccggcgacctgcggtggcccgcctgcccggccttcccctccggagtccgcgggctcgtcggcgtcttgcatctggggctgctcctcca

SEQ ID NO: 89005 - DNA, 336 bp, Homo sapiens
ttggctgaaaatgagcagattgagaggcaaggtgagagaggaaggcttaaccttgccgccaagagtctcatcctcaaatcctgatgcccggtggacatcaggccaccctcctgctgcagtgtggcctgtgtggccttgggctcccctctgctctgaggccaggggaatggctccactggactgtgagtctgggattccctgcaaaacacttgtgactccttctccaggaggaaaaggcagtaagggcctgctgagtacgggcaggtaattctgcataaatgcaaatgttccctgggagggatcaggacagcacagggaggaagcctgccctgtcaa

SEQ ID NO: 89006 - DNA, 1335 bp, Homo sapiens
aaaatacaaaaattagccaggcgtggtggtgcacgcctgtagtcccagccaatcagtaggctgaggcacgagaatcgcttgaacccaggaggccaaggctgcagtgagccacgattgcaccactgcactctaacctgagcaacacagactccatctcaaaaaaaaaaaattaagtcatataagaatgactgtgtatgaccaaaggcaaatatatgtggaagaaactcaccaggaattcttttgtgggtttttattcaatacatgtcagtaggggagttataccccctttttaataagtttgtgttaacctacagtctaaccaaggcatcttatcccagtgaatgccaccaccattcaccctggttcccaaactggtaacatagaaataatcttgacatatcttcctatcactttgtcatcaagtcctgtcatttttaccttgtaaacatctcttaaatgtgtctacttctcaccacaccctaatctaagctaccatcagcaccttttgcctgcatgactgcagttgtctcctaactgttcttcctgcagcgactctggccctccctgtattcactcgactgcaagcagaattctcctttttgttcgaagttcaattttaatcaagacaacccacctacctgcacttgcacccctagcttaaaatgctcgaatggctttttattgtccttaatgatgaaaaggaaatattttatgtgaccaaatatatttgacctatgaggtcagatatattagggccactatctaaagcatagttccaagcattaaaatagttactgtctcagattaaaacagtggctggcacatcacctcaatagaggttacctattcttgttgccacttagcctcatatgtaccatgttttacttaataccttcattgtcctttaagtattcggaatgagaattacagtgcttcattcagcataagacttttgttcatgctgtttctttggcctgaaatatctatcccttcccaattgcctaattaattcctatttgtctttcagatcttagctagttcatcacttcctcagggaaacattccctaatttctgtcacagagtaagacccgttgttatacgtctcacctgaccatgtacctctacttagcatttaacacgtgtaattttgtatgtattggtttgattaatgtcagaaccactagattgtaaactccatgaggaccggaattttgtttctgtcattgtcattgttcaactttgtattttttatgcctcatacagtgcctggcacatagtaggtgctcaattaactttattgaaagaataaaatgaatggatgaggtaaaaaaaaa

SEQ ID NO: 89007 - DNA, 138 bp, Homo sapiens
ccatctcataaccacaagtgctcatcctccatatggtacgaaactcagcacctcataaagtatagagtgaatctggaatcgtgcagttaaatgccttctgtaacactcttacatttgatctaacaaacattaactatt

SEQ ID NO: 89008 - DNA, 385 bp, Homo sapiens
ggagaggaggggagctgagagcacaggtacttggtgtcaggttttggggagtctgggaagaatttttggccagggagtgactgaatccgatttgcatgatacacatttgcctctgccaggagcctggagaaggattagcgcaggcggggccagggtgcagctgggagagcaggctagcatggaggaaggccgaggacctgcatggaagtttctggaaagcagacccactcctcatctcggaagctaccttctcagcaactgtggcttttcgctgcctcccttcatcatcggcactccccacacacatttcttacacctcacttctccctgaagccacagtagagacaaccaccctacctgccacagtcagtgaccgtttctcagt

SEQ ID NO: 89009 - DNA, 207 bp, Homo sapiens
gggattacaggcgtgagccaccatgcctggcccctgccatctgttcttacacagcggccagcactgcctcgttcacatatgtcatatcacgttcatctttccggctctaaatgactaaaaagcacccacagagcctgcaccgtgctcctggatggtctcctctgaccgtatgtcctccccttctctctctgtgatctgctgccccta

SEQ ID NO: 89010 - DNA, 564 bp, Homo sapiens
tgtcacatgactccaaagcatgcttgtgcccattcagataaacactggaatttttcctgtaatatgttgagggatttgggacacaggtcacaagcttaaatgtgctgtatttttttcattttttaatctatctatctaatctctccaatttcttgtctatgtttcactatctgtttgggcaaataaaattgatagtggtaccttgatttgctgtcacttggggccaggtgaaacagtgtaagacacatcgcccaagctgaatcaagggagcacttcttcggcccatgccttatcagtaatctttgacttccaccagctgaaactgctagagtactttactctttttccttcctcctcaaaattcaggagtaatgagaattccctgccgttaccgcctactagccctgtactgagattacatcagttcatttagctggagcttttcaggcactccttggcaggaattgatttccttatttcagtccttttgcctttggattctgcccaaaagacgattcaagaaaggaattctgctcttacaaggtctgtttcagataattacct

SEQ ID NO: 89011 - DNA, 325 bp, Homo sapiens
cggacaccgtggtacgcatgtgtgagttattagcattattattacgtatcccaattccaccacttactagctttgtgctgttggtaagtgtattagtccattctcacactgctgtaaagaactacctgagactgagtaatttataaaaaggacggttaattgactcacagctctgcaagctatacaggaggcatgtctgggaaggcctcaggaaacctacaatcatggcagaaggcgaagtggaagccagcaagtcttatgtggtaggagcaggaggaagagagagcaaagggggaagtgctacgcactttcaaacaaccagatc

SEQ ID NO: 89012 - DNA, 254 bp, Homo sapiens
acacccaatgtgaataagtctttaccaagagtcaggaggtttgaggtttggggccaatgtgattggactcaaggtaagtgttctagaatattaatacctagaggggaatgttgcatatgttattcttctgaataaaaaacaatgtcaaataatataattgatgtattgtgcaattcactaaaatgggttgggaaaaatgaatcagcttcaagcgatcttcattcctcagggatagaatctcagagttgagagac

SEQ ID NO: 89013 - DNA, 296 bp, Homo sapiens
tatatatatatacacacacatatattacatgtgaaatattgcaaacattttatatgtccaagtaggaaaatgcttagataggtatatatgtagatatttaaaatctttttaaagaattgaatgatataggtacatactgaaatataatgttaaatgaaataagatacaaagttggggctctcatatgatcccagttatgtaaaaataatgtgtgtgcaatagcaaagacatggaatcaacctaaatgcctgtcagtggcagattggataaagaaaatgaggtacatatacaccaca

SEQ ID NO: 89014 - DNA, 208 bp, Homo sapiens
aaaaagaaaaatatatatgaattttagatacatccaattaaaattaaaaagtatagtgcccttttaccttttatgctgaaaatcttggctcctcattacatgtttatttccttaattcatatatatttctcacccttgacactattgacattttgggccagataattctttgctctgggggactgccttgtgtgttgggggacgttta

SEQ ID NO: 89015 - DNA, 858 bp, Homo sapiens
gccgcgctttggcttcagcgactgtgcatttttcccctcctcttcctccctgccgccttgcagagaggactggtggagaatgcttgcatctgtaatgagccactgtatgcggtgaatgccagggcctgatccgaaccggcccagttaatggtagatgaggtccgagccacctcccaggagaacagggcactcctaagatgaggcgggcatttggagaggatggggcccacaagggaaaggaggaagcagtcatgggacttctttcacgagatcctgacccagagaagcccagcagcaaggcttccggttcattctgggcctcctctcacctctgctacagacaggcgtggcagcctgtccagctgagcaaatgctcagtccctaatatgtgcctctgctactgcccctccccagtgtcctgggtttgcataagagcccttgtgttgggaagagggggaataggtggagtggggagctgattggtcactgagggggtggggggccgggcagccgctagaaactggacttgtttttaattgtggggcctgggggaagggcctgagaagaaactctctttcatgccgtaattgggaaattccactttgctggcctcgtgcattctgccctgtggacagggcccttggctggggccaaatcaccaaggtgtccaaggccaccggccgtctgcaccactggcgcccctcccaagcccagctcccacatcaggctctgtcatcccctgcagctgccgaatctcgagtccatttggcatcgggaccccctcctcactctgtgagtctttgtgcggtgccccctcacctgcctggaggcattggccgggcccccagaagcccattg

SEQ ID NO: 89016 - DNA, 406 bp, Homo sapiens
tgggctaccctgtcactcttatcattgtcactttattgtctttgctcacttatctacttaccaccatctgaaattattttttgctttatttaactgtttatctgtctctattacattatcagccttggcaaacgcaaggatcttgctacacccccagctcagcatgtggttgtacagtatttttcatataagacgttcaatacatatttgttaaatcaatgaatgaattctacctgaaaccttcatggacctttgctcagtgagaaactttgctcatccatatccagtaaataagcgggagccagaaagtaaagaccaggcatctttccatagagaataaagttgagctcttgtggcccccggttcagccttaagaggggaaaagagaatgacttttcaaagctta

SEQ ID NO: 89017 - DNA, 1337 bp, Homo sapiens
attgaggttcgaaattaataaagaaaataaaagaaatgtatcttcattcattctgtatgttagtgttttaattacccttagaatatatggataaaaaatactattctttgtcttggagaaggtaagagtctagttagatgaataagggttatctatgtagaacaactagagaatgagaagagagcttatgagattgagtactacgttatgcagtagagtagcacgtcatctgctactgagtatggtgtgataacattgtgtaacaggaaagtatgatcaatatctacttaaaattaaggacaatattagcactacattgctttattttaaagtaaaaattagagaactaaacacaagcattgtaagtacaataaaagctgatctttctagttaagcagaataatacatgttcaagcatctgctaaatcattaaatataagaatataggggttttctataatcttatttttctttggaagagtacctcattttcaagaggagaagtttctaattgaccacttctttaaaaataaaacagggtttttaatgtatcccagcaaaaaaaattaatatctcttcaaaaagttctcttgtgattaagtttgaattccctttgtcatactgcttctaatattgtacactgacctccttagttatttttcagtgtttataatcttttcttaggttatcttttttcaagatttggattactttgttcttttctgtgtttttcagcctttctaagcttttattgatactcctgtaagtgtttgtggcaaatgtctgggtttaagaaaaaccatgaaataaatattataataaaagaggttatgccttttccaacaatgttttctaatcattttattctgttagttattgtgagattctgtaatctgtttctgaaagcccatttagttgattgtttgccagatagtttttatattttagaatagattgcatgcacacttttcctcatagagtcttatatttctgaagtattttggtgctttcaaataaccttatagtaataaatgtaaattacattgctatgattttccatatttattaatgataattagtattgttgcgttcatggtaacttgaaaattgccttagttcttctatttagttttcaaactgatggcagtttgcatgaacacaatttttcctaatgtctgtatttcagaagaatgcatgagtgtttgttttataaccagatttgtttctgttttttcagaagtcatattttaattcctgcaatttatttaatggaattatcaatatcttttgcatgtaagcctataggtttcattaaattcaaaaagcaaaaatgagat

SEQ ID NO: 89018 - DNA, 935 bp, Homo sapiens
cttggctatgctataatgcggctttgaggatcaaataaggagcttgagagcattgaaagtaccaccaagttgagagggggaagacctcatatgcaggagaggattaactttgcccatacaggggtctggcctttgccctcagctcctggaagataatctctaaaccactggaatatcctgcttgataagaatgtttacctgaggactttggaacaagctccataacctatgctaacaatgtaatcgataatgcaggctttgggccacacagctccagctcagcctccggaagggctggaaactgaccatgtcgatgtgacagaaccccagtaaaaactgtggacattgaggctcaggtgagcttctctgggtggcaattcatgcatatcctcacacatcactgctgagttagttctccactgggaaagaacaactggaagctttgcacgtggagctctcctggactcttccccatatgcctcttccctcagtttatttatttatttagagacagagtttcactcttgtcgcccaggctggagtgcagtggcgcaatctcagctcactgtaacctctgcctcccaggttcaagcaattctcctgcctcagcctcccaagtagctagaattacaagcatgtgccaccaccagcacacctggctaatttttttgtgtttttgtagagatgaagtttcaccattttggccaggctggtctcgaactcctgacctcaggtgatctgcctgccttggcctcccaaagtgctgggattacaggtgtgagccaccacgccccgccccctcagctgatttaaatttgcattctttcactgtgataagccacaactgtgagtataacagctttcagtgagttctgtgagtccttccaacagattgtcaaatctgtgggtggtcttgaggatccctgaacttgcag

SEQ ID NO: 89019 - DNA, 295 bp, Homo sapiens
gggagggagagcctcaggtagaatagctaatggaggctgggcctaacacctaggtgttgggttgatctatgcagcaaaccaccgtggcacacgcttacctacgtaacaaacctgcacatcctgcacatgtaccccagaacttaaaagttgaaggaaaaaaagagttctgtttagaaaagttaatgttctgttaggaagatatacttgctaactttaagaacacattgattaaacggacattgttgctttcctgctggaaactgagtcttgacgctctggatgaccattctccacc

SEQ ID NO: 89020 - DNA, 1871 bp, Homo sapiens
agttgtggccaccttccccaggccatggatctctccaacaacaccatgtcactctcagtgcgcacccccggactgtcccggcggctctcctcgcagagtgtgataggcagacccaggggcatgtctgcttccagtgttggaagtggttatgggggaagtgcctttggctttggagccagctgtgggggaggcttttctgctgcttccatgtttggttctagttccggctttgggggtggctccggaagttccatggcaggaggactgggtgctggttatgggagagccctgggtggaggtagctttggagggctggggatgggatttgggggcagcccaggaggtggctctctaggtattctctcgggcaatgatggaggccttctttctggatcagaaaaagaaactatgcaaaatcttaatgatagattagcttcctacctggataaggtgcgagctctagaagaggctaatactgagctagaaaataaaattcgagaatggtatgaaacacgaggaactgggactgcagatgcttcacagagcgattacagcaaatattatccactgattgaagacctcaggaataagatcatttcagccagcattggaaatgcccagctcctcttgcagattgacaatgcgagactagctgctgaggacttcaggatgaagtatgagaatgaactggccctgcgccagggcgtagaggccgacatcaatggcctgcgccgggtgctggacgagctgaccctgaccaggaccgacctggagatgcagatcgagagcctgaacgaggagctggcctacatgaagaagaaccacgaggatgagctccaaagcttccgggtgggcggcccaggcgaggtcagcgtagaaatggacgctgcccccggagtggacctcaccaggctcctcaatgatatgcgggcgcagtatgaaaccatcgctgagcagaatcggaaggacgctgaagcctggttcattgaaaagagcggggagctccgtaaggagattagcaccaacaccgagcagcttcagtccagcaagagcgaggtcaccgacctgcgtcgcgcctttcagaacctggagatcgagctacagtcccagctcgccatgaagaaatccctggaggactccttggccgaagccgagggcgattactgcgcgcagctgtcccaggtgcagcagctcatcagcaacctggaggcacagctgctccaggtgcgcgcggacgcagagcgccagaacgtggaccaccagcggctgctgaatgtcaaggcccgcctggagctggagattgagacctaccgccgcctgctggacggggaggcccaaggtgatggtttggaggaaagtttatttgtgacagactccaaatcacaagcacagtcaactgattcctctaaagacccaaccaaaacccgaaaaatcaagacagttgtgcaggagatggtgaatggtgaggtggtctcatctcaagttcaggaaattgaagaactaatgtaaaatttcacaagatctgccccatgattggttccttaggaacaagaaatttacaagtagaaattattcctttcagagtaacatgctgtattacttcaatccctatttttgtctgttccattttctttggattccctattcacattgaatcctttttgcccttctgaaacaatattcagtcacaagtcattttggtcatgttggtctttgtaacaaatcaaaattaccttatatccttctggacaactggagtagtcttttaacgaactttcttctggtaacccggaatattttcttaatcatagagctttactcaagtagtattgttttaatagagttaattgtaataaaagatgaatggtaaa

SEQ ID NO: 89021 - DNA, 173 bp, Homo sapiens
ttgaggtgccatccatacccctaccagcaaatatagaatgcagagcacaggcttccacactcgcatcgcaacccttcctcccctaccagagtgctgtcagagagggcccacaggaagccagccctcctctcccaccacagtgtcagtggacaccacacagggagcctagacgt

SEQ ID NO: 89022 - DNA, 571 bp, Homo sapiens
gggaaaactacaaaactctgatgacagaaatcaaagatgaatttttaaaaaatgatatcccatgttcatggataggaagactcaatattgtcaagatgccagttctccccaatctgatctacagatttaatgcaaatcccaatctaaatcccaacaagttattttgtgtatttcaaaaaactgattctgaagtttatatggagaggcaaaagacccaaaatagccaacacaatattgaagaacaaagttggaggtgtgacaatacccaacttgaagactattaaggctgggcgtggtgactcacgcctgtaatcccagcactttgggagactgaggtgggtggatcacgaggtcaggagttcaagactggcctggccaagatggtgaaaccccatctctactaaaaatacaaaaattaaaaattagctgggcatggtggcaggtgcctgcaatcccagctactcaggaggtgaggcagagaattgcttaaacccaggaggcggagggtgcagtgagccaagattgcaccactgcactccagcctgggcaacagagcaagactctgtctcaa

SEQ ID NO: 89023 - DNA, 383 bp, Homo sapiens
acaacagctagttaattgtaagttttgaatttctgtatttatagaaacattacaacactttatttggaacagcattcaatgaatgcattgccttctaaagggatttgctgaatcacttgatctagtttgtgatccattcaacactttcatagaacttaaacattatgtgtgtgaagcatcagcacagctgtaattgtgtcccataagcacattttttactcctacattcaaatcttgattcctactcatgagctctttcagcattttatacctgtttactcaaaacaacttgcctaagtcagagctttacaataatcaggtgatttttttgtcctcaccctttatttttctcccaagagttagtgtttgattgcagctttaca

SEQ ID NO: 89024 - DNA, 357 bp, Homo sapiens
cctcaaataattcagcacaattaaattcagcaaatatttattgaacacttggagatgatgatggaaaattatgttcacatggtgccatttggtacaacggaaatggcatgagatttggaccaaaccagaattgtcttaaatcctggctttgttagttttaggtatgtcatcttgagcagttcacttcactttttgagccacaatttctcttccttacataaagatatttataaataccccacaggttgttataataaaggttgaagatgcttggcacataagcaaaaattatgaataaatatgtattaaaatataaaataactacaaaataaaataaaaatattgtttttctcacca

SEQ ID NO: 89025 - DNA, 404 bp, Homo sapiens
ccaggtgcaatggctcatgtctgtaatccaagcactatgggaggctgaggcaggaggattgcttgagcccaggagttcaagaccagcctgggcaacatggcaagaccccgtctctataaaaaaaaatacaaaaaattagccaggcatagtggcgcatgcctgtagtaccagctactcaggaggttgaggtggggggattgcttgagccagggaggtcaaggtggcagtgagctatgatcatgccactgcactccagcatgggtgaaagaactagaccctgtctcaaaaataagtaaacaaaataaaagtcgaaatgattcttttaaaaaagtgacagagccaggattgtatctgaagtctttttgacattaaaagccatactttccatactaccttatgctgct

SEQ ID NO: 89026 - DNA, 467 bp, Homo sapiens
cttaactccaactccaaaattacatcaccccctccctcaaccaacacccttcagcggcctccccctgcacatcaggtaactcccaagctctggctgggcttctgatgcctcttcttatttattttattagtttattttatttattttattttttgagatggagtcttaccctgtcacccaggctctcaaaaaaaaaaaaaaaaaaagctctgatgtccatccacctctggcttcctgttgcctttggaataaaatagaaattcctcccactgtggaccctccctatctcaccttcctctccttccccggcacacaccagggtatgtcttcaccggccttaagttcctccatgttccaagcttgttcgtgcctcagggcctttgcacttgctgaccttcttgctgaatctcagtgcaaatgtcccttcttctcatagtccttcctatccccccaaaccagttacccca

SEQ ID NO: 89027 - DNA, 391 bp, Homo sapiens
caaattctttcagaagtgaatagatcaactgttaaaaagtagaaaaacaattggcttactctgcatggaatcatgaaagtgtgaagatggaaaagaacagaggcatagttcaaaatcctgataaatcacttaatagaaaggacaattttgtaaatgtttttattttaaactttcacttcctcacatgtaaaatgaagttgatagtactaacctcatatgttggattaaatggtataatgtaaatagatgtactttgcaatatgtaagttattgcataaatataaggcatcatcatctatttcttataagtctaggctaatttctacttatcttagaaaacgaatattaccctggggattcttcgaagaagtaactaaacatcattttagaa

SEQ ID NO: 89028 - DNA, 378 bp, Homo sapiens
acgaaggtttgtattgaagagttggcttcattgctgtcatagcctgcttctttctagtacaggtttggaaactccattgttatcttatgggttcaacagaattttgtaaggtaagctagtattttttttctataccagtagtgcagaaattcagtaggcttacagtctgtttgcttcaaatcagtttcaagtgtgagtctcttcagccaaacgcctcattagacacaggctttcagcctaaagattctggtattttagtttctagcctctgtgccctactcacttcctttgctttcaacttaatggcagccaccttgatatcatctgaaaaaaaggatttgggtgggaaggccaccccttagttcaatttggccaata

SEQ ID NO: 89029 - DNA, 391 bp, Homo sapiens
cacccctcggatgcctcctccttcccttcaaacatctcccatagaagttccccacaagttgccggccatgtcctcaaagaccttttctccactttggttaggctgactctcgatcccttcactctcctaaacattgcttctctgcacatggaaagacagctgctttccctgccttcaggccactgtggcttggcccagtagctttttgtcccgttttataacatttattgccttttcctctggttacagaagcaatacgtgcttctgagattttctgatttctcaaagaggagattctatattcttccttggttcaaccctattgagggagaactgaacctgtttggatatttctatgatacgcttgagagaatgtggggctgctactctg

SEQ ID NO: 89030 - DNA, 192 bp, Homo sapiens
tgggaggttgagaatggctgaagaccagatggggactggaagttgagggtaggtactaagcttgagagaagatagacatgggtaaggaacagagtgtgcggggcggcagcccacagagctataacagcaagcagttctcagcccaagccagccttctgcctctctttcaattcacctcatttgctacctctg

SEQ ID NO: 89031 - DNA, 170 bp, Homo sapiens
atgaaatgttcatgacacacaaagcaactttataggtactcctgacaaactcagtaccatattggttatggactctggttctgcaagctgacgttctgggctcgagtctcctttctgctgtttaccatctgtgaaaacttggtcaagtcttttgcttcttctcttagcct

SEQ ID NO: 89032 - DNA, 189 bp, Homo sapiens
cacaggaggcatcagaggcagggctggatggctgctctgcagggtgagggctgttgctaagggagcttcagtggtggtgatggacatgaggccggggaacctgtacctagtggaaggaccattgctttctaaacttaaacagcccctttcctggggaacaagctctaactcatgctgtgaaaccacgac

SEQ ID NO: 89033 - DNA, 474 bp, Homo sapiens
taatttttccacataagccttcttcataaatgttttttattgtgtagagtttctgatttactaattttcttattgtgagcactatatttatcatctttgtaaatgatgatttcttttctgataggctgtggaacctaacatttacatctgattatctgccttccctattgactcagactgtgtattttttgtcttgatttttatattgtaaatatgtatattgcaggaaaagattgtatagccaaactttgaagtgtccaattactaaaagttgaggttttagtgggagaaatattgtaaaagattctggtattcctgtttgcaaatatagctttggtgaacagttttctcatgtgaaggaaaaattgcagaccacaaatttgtggcttctgtttccttatttctcaataacaagcttttacatctgcccctcccttaaaatgacatgaaattaaataaaactaccatttatga

SEQ ID NO: 89034 - DNA, 609 bp, Homo sapiens
cattagtttttaggtgtttttgttttaaaatgcagggcagcttgggttaaggggttatctaatgcaatatattttgccaaactgaggtgctgaacaatgaaacatttcagtttaaacttgcatcaagtcagaaaaccctcaagtatggtatcaagacttttctgacaatgaaaatccaatactgaatgatcaacttttaaaatgttacagattctggcagtttctctcttgctatctttgtagtctttctaagtcatctaaactattggttagttatgttagcttcttgtgttgcaaagaaaaagagcatttttagaaatctgacaagaaattttgtcaaattgctacacataatttgtatataagtacataaaagcacaatactagctagcattgaaaaatttgaataaagatcagagatttctcacttttttcccacccctgtccaatatactgtggtattaaatatttaatatatgttcattttttctcttcctttccccaacccccacaaagctgttatcaatctggacagatgaataaattttggcaaaataagatttgtttagaatggtaagaattcttcctaataaagtttttaagcaagtc

SEQ ID NO: 89035 - DNA, 387 bp, Homo sapiens
cagctggtcacctggaatgcctgcgctgcagtcaggcagtgaaagggagggggggcaagaggtgcactcgctggaaataggccccaaatgagcctgtcccttgtctcacttgctaaaagggctgcccttggtcaggctcccgagaccaagggagagtctggcagagatggtgaggccctggtgcagcatcaactcctgggatagcgaggaattacattcttcctccttggatagcaaggaattacattcttcctcctgggataccgaggaattacattcttaagtgactacagaatttagctagtccaggaggctggatccacacttgtctaagaggattcctttcctttccaagcctcagctccactgatcctcctgtttaaggct

SEQ ID NO: 89036 - DNA, 420 bp, Homo sapiens
tggaggcatctttgccttggcctgcttggaaatgagcaggcatcagaggcagatccaggacctgacaggaccagggaaggagtggagaagtcaatcttagccgcctttaccattagtcatggacgggccttttagatttgctcttatcagtgtctgggaaattggataaaatttttaatgccactcccgactttcctttctccctgtaactactcctctactgaatgtgtactctaaccacagaatgctgtggtaggtcaaatggagactgaaaaataagaaaatgaaaaatggaccaaagatgcttataaacaaagcatgacaagacattccagttttcgatggcagggtcatagaacttacacattgattgtacctgccaaatgagttagttggaaagggaacacaatttctcttcca

SEQ ID NO: 89037 - DNA, 179 bp, Homo sapiens
ggggggtgtgcgttttccaggtgagagtccacgggggacagaaggtggaagaacgaccctgcgcgcccaggaagccttggagggtcagctagggacttctgactctgagagtggctctgctgttcggggttgggggaaggaggtgtcatcgcaggagtcgtggtgtcagggcttaagga

SEQ ID NO: 89038 - DNA, 366 bp, Homo sapiens
ccatgtgtaagcttctctaaataggaaaccacaatttgtcaaatatgtttgccataatttgtcaataaagctgaaaacttttgtaaaaattaaatttggaattacttgttttctagctttaaatgcctgctttatttcttcttcaagagatgcctaaaatgttttctatttaaaaattacaaaaatgaacccaagtctgttttaagatatttgtgtaatacttaaaaatgtattaataacttatggttgttaaataatttaaaagttaacaaactaaactgttacatgaatcatggttagtaaacactaatgtataacatgttaatggaaaaaaatggatttagaataataaatggattttaaact

SEQ ID NO: 89039 - DNA, 619 bp, Homo sapiens
  misc_feature (30)..(30): n is a, c, g, or t
  misc_feature (35)..(35): n is a, c, g, or t
  misc_feature (42)..(42): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (447)..(447): n is a, c, g, or t
cggggtattacaaccccctgtgacgccatnaaatnttcaccnaagacccctaaacccccacatctccatcacctntacatcncgcccngaccttagctcccaccatcgctcttctactatgtacccccctccccatacccaaccccctaggttcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccaaactagcagagaccanccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcattctcc

SEQ ID NO: 89040 - DNA, 489 bp, Homo sapiens
  misc_feature (317)..(317): n is a, c, g, or t
gcctcagtgttatgctgatgactttcctaggaattatagttttagctgctgacccagagaagcctttttcaaatccttgaaagagaaagacggctatctccacacatcaagcaatcttgcgctatccgtcacacatgctgaccaaatcagtttcatctgatacaggtagcatttcgtagataccaagagccagtgttggcaattctagggatgtggcttttctccacccttatcacaacacaagaacacctctgattactcctgccatcatgacccttggccataatatgatttatctccaaactagcagagaccanccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcattctcc

SEQ ID NO: 89041 - DNA, 641 bp, Homo sapiens
  misc_feature (30)..(30): n is a, c, g, or t
  misc_feature (35)..(35): n is a, c, g, or t
  misc_feature (42)..(42): n is a, c, g, or t
  misc_feature (75)..(75): n is a, c, g, or t
  misc_feature (82)..(82): n is a, c, g, or t
  misc_feature (88)..(88): n is a, c, g, or t
cggggtattacaaccccctgtgacgccatnaaatnttcaccnaagacccctaaacccccacatctccatcacctntacatcncgcccngaccttagctcccaccatcgctcttctactatgtacccccctccccatacccaaccccctaggttcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccaaactagcacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaaggtaccgagctcga

SEQ ID NO: 89042 - DNA, 511 bp, Homo sapiens
atcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccagtcaccctagccatcattctactatcaacattactaataagtggctcctttaacctctccacccttatcacaacacaagaacacctctgattactcctgccatcatgacccttggccataatatgatttatctccaaactagcacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaaggtaccgagctcga

SEQ ID NO: 89043 - DNA, 397 bp, Homo sapiens
  misc_feature (225)..(225): n is a, c, g, or t
tgtcctgattgggcctacaatggagtgtattaaacaaaccctggtctgcaaaacccagggtcagttaaagctatacatcaatgtgcactacatgtcaggattctattcacgtacaaggctcctttaactctccacccttatcacaacacaagaacacctctgattactcctgccatcatgacccttggccataatatgatttatctccaaactagcagagaccanccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcattctcc

SEQ ID NO: 89044 - DNA, 315 bp, Homo sapiens
aaagtgtcaggactacaggtgtgagccgccgcacctgacagtcgttgactatttgaacagtactgtcatcacgcttgtacctgtctttgtaaacacaggtaagcgtttctgtggagtgtgcgtctaagaatatgacttctgggtcataactcgtgcatgttcagctttaggagacactatgatactatcaacagtttaccaatgaagatgcaccaatctgcacccctaacactgttacgagtttcagttgttccacatctttgccagcattaaatattttgtctttttcatttttttaacctgtatttccatgat

SEQ ID NO: 89045 - DNA, 516 bp, Homo sapiens
ggtccgtcggacgtgtatctcaatcatttcttacatagctttatgattgaggataacattagtatgcacatacaacataacacacaaaagcaaagcttagaataacattttaattatgttttagtgtatgtgaaataatttgtttttctcaattatattcctgggtcaaggcctaaaacatttatttgaaccagctatatatcttattttcataagggtctcaggaggcagtagtcatatgttgttacttcagccctccacaaaggcaatacagtacagatctctgtactgtaaacgacaacaaggaccagtcacaatttcagttcttgttacattgataagactccttcaggtaagagattaaaacatgcctttattattataaggttagtgaccattttaatggaataaaaagattattcctgttgcattggagataggaaatttgggatgtgaatgtatgaggtaggtgtcttttctctcttgtgcctgtattgttcaaaagctctttgacat

SEQ ID NO: 89046 - DNA, 264 bp, Homo sapiens
tacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagttt

SEQ ID NO: 89047 - DNA, 363 bp, Homo sapiens
gcaaatgtgaaggcgggaattgcaacggggctatttccaaaaacttccagaagggaagtgtaatcccttggactagcatggtggtgatggaaataggggataaactggttagggaggcaaatctagaacttagttttgaacatgctggtttgagatgtgtgtgagacacccaactagatgtgttcagcagccagtcatacaagctggagtgaaagatgaggtgtcggctagagatgtagtagaatctcatctgacttcagtgttaatttgtaaagtcagcatgtaaggccaaagaataaacaattaaaaatcatccttcaaaaacccttagagctgtggacctgagtctttggaaactcaaaa

SEQ ID NO: 89048 - DNA, 436 bp, Homo sapiens
tgagacagagtcttgctctgtcgcccacgctggagtgcagtagccaatctcagctcactgcaagctccgcctcccgggtttacaccattctcctgcctcagccttgggaggttgagactgcaatgagctgtgattgggccactgcactctagtatgggcggcagagtgagtccctatctcaaaaaataagtaaataataaagttttccaggtgattctaaatgggcagccatatttgaaaattcccattctagactgctaagttgaactgcctaaacaaaagatctaaagggagaaaaaggccaggcatggtagctcacgcctgtaatcctagcactttaggaggctgaggcacacagatcacttgaagtcaggagttcgaaaccagcctggctgacatggtgaaaccccatctctactaaaaatacaaaataatt

SEQ ID NO: 89049 - DNA, 287 bp, Homo sapiens
tttcctcctttgggtgtgttttagcttccagctgggatttttgccatagtaattataacaaccacactctgcatagagactctaaaagctatataggcaaacacataaatagaaaggaattcctaaggcaagccaagtagttatcagaatctccacccctaccagagtcggaagctctgtacttgcctcctggtaactgcttagtgagaattatttagccagcttggattctttctacaaccacattgaaatcagatatcctgagggaaggggaaggtttatcccac

SEQ ID NO: 89050 - DNA, 372 bp, Homo sapiens
ctgtgacctctcccccaaggaggaggtgctcgcatgcgtccagtgccctgcccattagattagggagggttcccttttttgctctcttgcactcatttgtccgccttttagctttccttttctgccctgactctcacagggtcgtgcggatgtgcgatgtaggaggaggagagaggtaaagtggaggaataggagctggaggggaggaggagagaagaaaagaggagaaggagggggaagagagggagcgggttcaaggagggaaggaggaggagaaggagaggaggaggagatgagaccaaggagaagaggtgaaggaggagaggaggacacagaaaagagaagaaagaggagaggagacggagaagagga

SEQ ID NO: 89051 - DNA, 460 bp, Homo sapiens
ttttttaatatagagatggggtctcactaggttgcccaggttggtcttgaactcctgggctctagtgatcttcctgcctcagcctcccaaagtgctgggattacaggcatgagcactgcttctggcccctctgctcttattataagctcctgaaggactattccgttaataaattcaggactctgcaattgtgaaggggtgactcttgagctagtagacagtcagctactgaaattttatttccatatgcaaccagctccatgagaaaacagtggtattctgatttgtccagtaatcccttgtgaggatggtattcatgcattcatttgattggcataaatccatctccaaaacaaatcatccctgagaagtcagtaaaattttatttcctggacatgtgttactagaaactggaaaatttaagaggctgcacctaaattgtgccccaggagaagtcttg

SEQ ID NO: 89052 - DNA, 430 bp, Homo sapiens
acgaagtccaacacaaaggtataatacagcctggtgtctaaagccaaggagtcataaaaacctggactctatggggtggtgcagaggggtgcagggaaagcaccttcatatggtcactacagaagaaaagctgtagttgaaaaagaagacgttagcggcaaacgtgaccttgtacatgcaaaaagaaacaccaagcttttctaaagcatcccaagaggtatactgttaggagcaaagtgaagccctgtaatctagtgatttagtcatttagtagtgttctgggacatggatccaggggcagagtggctccccaattgtaaaacctgctttgtcatccggaccaatggctttcactagagaacgtcttaaaggagccatatgactctgcaacaagaacccagaataaagtggtatcaaaaataccaaaagg

SEQ ID NO: 89053 - DNA, 356 bp, Homo sapiens
aacccgtaagtaatctcaaggcagcacaaaatcataaaaacctggactctatggggtggtgcagaggggtgcagggaaagcaccttcatatggtcactacagaagaaaagctgtagttgaaaaagactaaagcatcccaagaggtatactgttaggagcaaagtgaagccctgtaatctagtgatttagtcatttagtagtgttctgggacatggatccaggggcagagtggctccccaattgtaaaacctgctttgtcatccggaccaatggctttcactagagaacgtcttaaaggagccatatgactctgcaacaagaacccagaataaagtggtatcaaaaataccaaaagg

SEQ ID NO: 89054 - DNA, 859 bp, Homo sapiens
tttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcctccactgatttttaaaaatccagtcaacagtaggattttcttgttgaactgtgaaggcctgtgctcggtagggactttgtgaatcatccctgtttgggtcccagagccactggagggcccatcactggagtggctggtgagacactccagggcatgagagttgctatgggcctctgtgtggcttctagaggcttcccaggggcacaaagactatgtgacccaggtggaagctcgggaggctcacgctggacacatgctgcacactctggctcccctgtggctgcagctgcacccacctacccagcattctccccacgacctgtccagcccaagcccacggcactcccaggggagcccaggacaccctcaactttttagtggattactagagtatcagaccacccatttatctctcagttcctcactcccacccctgcacccagcaagtcaccaagtcccccaggtgagtaaactggagctaacagcagttggtacttacggcatatactggatttggctcactcacacgtggtattcctatcttcatctactgtatc

SEQ ID NO: 89055 - DNA, 536 bp, Homo sapiens
  misc_feature (500)..(500): n is a, c, g, or t
ttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgacccattgcgcctggccctttcttcagtctttaataatcgaacaaaaggtttttgtttttagacagtgtcttgctctgttacccaggacagacctctcgtgtcagcctcttaggtagctaggatttacaggtaagcaccggcgtgccctgctttatttttttgtgggggaagggggaagggagttgaacctgtatatggcttaaaagccttttgaaacccagccccttttnggctgtcacaaaaaactgacatgacacggactgaat

SEQ ID NO: 89056 - DNA, 360 bp, Homo sapiens
aatcagtctggacatacctaattattctagaaacccataaaaatattttaatatgtgtattttagtcttgtgctctttcctaatcagtcatgagaagtaatttttcttttcaatgaaactgagaccaaaaagttgagacttgctgatttctgtatggtaataagttagtaagagaccaacatcaaatttaaaatttgatgccttaaaaattaggttatctcatgccattatttaatttcttttttcaacacctgtactactatataatgattaatctcattttatttcactgagaaacactttgttctgattaccttgtttctaaaaatattaaatataaggtgtatctgtctaaggatc

SEQ ID NO: 89057 - DNA, 434 bp, Homo sapiens
ctgggctgtttccagtttcatctgttttaaacagtgctgttttgaaccttctgttaacctggtgcatatgttcaagaatttctacctaggaatagaagtgctagttgttcacccacagggtactgccaaactactatacttggttccattggtctgtttgtctatctgtgttcctattctcttgcctctgcctcctaagtagtgggattacaggcgcgtaccaccatgcctggctaatttttatatttccagtagagacgggattttaccattttggtcaggctggtctcgaactcctgacctcctcatctgccctcctcggtctcccaaagtgctgggattacagttctgagtactgtagccttatagactgttttgatctccctttctcctatctccccaatttctttcctctttcagggtctcttggcttt

SEQ ID NO: 89058 - DNA, 822 bp, Homo sapiens
gactgtgcatacattctgtgatagacttgttgctaaaatatggtatgggaataagtagccgtttttgagaagttactaaatcttaggcatggtgctaagaatgttatataaattactttttgcagtctgtactacaaccatatgagacaggcgtttgtttattatttccattttacaggagaggaaattcagggacaacaaggttaaaaaatttgcctgggtcacataactgatacattatgaggccagaattaaaatgcttgtggtttgacttcagaagcaactctcttaatcctaatgctgtgatggctcccacataactgaataacagagccaccgtggatagtgtctatgagagagagaaacaagcagatctgtctttactgtgaagtgaattttgtggcagtagtaagtaagagatgccatggggacatattagtgggggcagctaaatcagctttgggaggtaaggacatgaggaaatggtaaggggagagaccttgttaatcttttcactgtcgtattcccccacctggccatggcagtacttggcaagagaatgtgctaaacaggtactgttaaactggtaaattaatcaggtgtgacatctaagcaaaatcttaaaatttcaatgtatgaaatcccaagagatctctttgagaaattcgtatgattataatgtagatgagtctcagactacttgttctatgcattgttatattcttactgtatagtatctaaaacaccacctcagtgttactgaccaagaagactaagtgtcactccaatttattatagtaaggctacattggaaaaataacg

SEQ ID NO: 89059 - DNA, 341 bp, Homo sapiens
cacacattcccgcaagccatccttccgtgctgaatatgtatcaacaggaaggaaagaaaccctttctctgagctaactggggagcgctgggggcttgtctatctctgtgctgctgctctgcagctggaaaaagccacagccacgagtagacatccctcggaaacagtcgcctgcaactgtttctgaagcaaccaggacttgctgctgacgtcaatactccctggaaaattcctcctgcaggcttcagaagagaccagaggaaccagggcctgattggagttgcgagagtctttggcacaagcctgaaatgaagggaggtgaagaccccagtgggcagggcg

SEQ ID NO: 89060 - DNA, 316 bp, Homo sapiens
ccatatagcctaggtgcgtgtagtaggctataccctaggtttgtgtaagtacactctttgatgtttgcgtaatgatgaagctgcctaacaatacatttctcagaacatatccctgtcatgaagcaacgcatgactgtaaatgtaatcatacaatatgtgactttttatgtcttgtttcattcacttagcataatgtttttgaggttcattcatataatttttattatgtacaatgaaatgtaaaatcttgtgtacatttgcctatttttgaaaaattcatatgtgtgtaacccaaacctttatcatcatatcgaat

SEQ ID NO: 89061 - DNA, 313 bp, Homo sapiens
tttctgagtatgctgcactggattattagcatgttaaatagtcaaagggactggaataaacatcaggaagatttcataaagtggtgtaagtagaaaaaaaaggttaaacaatgagctgcatgttgataagtataagacactgatccaagtggtggcttctgaaccatgatattacttaaactagagtgttaaggtcagcttaagtcaaaataaaacaaagcttccaaaccctcattttaaacacagtagataatagatgaatcttgtatcttgggagatagtacaagccaaagttacagctgtgttaaaacct

SEQ ID NO: 89062 - DNA, 403 bp, Homo sapiens
aaatctgttggctaattttttatttgtaaatccatggcctgcttcttgtgtggggaggcttgagtaacctctgaatgtattttgcaaactccccaaccccagtcataattcctctaacctcaatactgttagttgaggctaggagaacagtgatgtttattgacagcatctgtttgttgggtgacatgtttttggaaagcgttctggtaaagaaccaggtaagaaaagaggtcaagggtagtagcagctacttcagccaaagaaacaccactgtaacttacaaagtctcaggaagtaggtcgaaggtgtgtgtggtaccttattatattttggaggactgttttactgtccttctgctgtattcagtgtacgtgtttgctaactcactgagtttttgccaaaa

SEQ ID NO: 89063 - DNA, 618 bp, Homo sapiens
tccatgaacatgaatgtctttctgtaggtgggttattaaaaaaaaaaaactacctatgtgaaaatgatacttgtatattaataaaaagtcaaataatatagcaatgtacaaaggaagaaagaacacattactccagatctcactactcattgataaccactgttaagtttctggtgaacatctttctgagcacctctcttacaattttacataaataggatccatttgtctcccatttaatatgtaatagttgttttctgatgtcaatgactagatttaaattatgtttgtctcatcatttacttaagcaaacttaccctgatagacatttaatttgttgtctgtgtactgtgagtaatttttattaatatcatagtattaatggccatccatagctattgtggactagtttcttctctgtcctagtagacctttaaaaagtttagggaaaactgtataattttgaatgcttaatgttgttgcttttgaataaagaaaagtacaaagtttttcatctaatcagttcctgcatatctgatgtactgtaatgcataaataatagatctttggtgtgataatttgtgaagcaataaagggcagagaaccagaaaaaattta

SEQ ID NO: 89064 - DNA, 790 bp, Homo sapiens
  misc_feature (779)..(779): n is a, c, g, or t
atagtaacaactatcagtaaagtagatggtgatcttggtattgcacatttgaaaaggttacaatcaaataccttacaaatttgataggacacttttattttctatcacaagaaaattcataggtaagaaattcatagatgaggaatcaatttttaaaacgagaagtcactttcgatttaactgtaaatttgctggataaattattggaaatggataccagtcagtgaaggattgaaaacaaattttgaaaagcaaattttctacatttttgacaaaagtttttaaaaatgaatgtccgagcttgttgaaattgcattaaaatcactgctatttctgtcctttgagactgttttctctgattgctattaaaacaaaacacagaaatagtttagatatacattatcccttgttgagtagcattgtcctcggtccaacctagattaacaaatgtagtaactggctttcaagatagcccccagtgaaccctacctcctgatgtttgcactgtgtataatcctctcacacaacataccaagttgatatgtgtgaacaatagaataaggtcagtgtgatagtatgtcacttttgaggttgcgttatgaccgacactgcagcttctgtctcagttgctctgtcagtttgtctctggaagccagctgccatgtggtgaacaggccagtggagaggccaacatagtgaggaactgaggctgttgtcatcagtcatgtgagtgagcctagaagcagattctccagcctgggcaacaggagcgaaactcngtctccaaaaa

SEQ ID NO: 89065 - DNA, 1009 bp, Homo sapiens
atagtaacaactatcagtaaagtagatggtgatcttggtattgcacatttgaaaaggttacaatcaaataccttacaaatttgataggacacttttattttctatcacaagaaaattcataggtaagaaattcatagatgaggaatcaatttttaaaacgagaagtcactttcgatttaactgtaaatttgctggataaattattggaaatggataccagtcagtgaaggattgaaaacaaattttgaaaagcaaattttctacatttttgacaaaagtttttaaaaatgaatgtccgagcttgttgaaattgcattaaaatcactgctatttctgtcctttgagactgttttctctgattgctattaaaacaaaacacagaaatagtttagatatacattatcccttgttgagtagcattgtcctcggtccaacctagattaacaaatgtagtaactggctttcaagatagcccccagtgaaccctacctcctgatgtttgcactgtgtataatcctctcacacaacataccaagttgatatgtgtgaacaatagaataaggtcagtgtgatagtatgtcacttttgaggttgcgttatgaccgacactgcagcttctgtctcagttgctctgtcagtttgtctctggaagccagctgccatgtggtgaacaggccagtggagaggccaacatagtgaggaactgaggctgttgtcatcagtcatgtgagtgagcctagaagcagattctccagcccagttaagccttcagatgactgaagccccaaccaacatcttgattaaaaactcatgagaagccccgaatcataatcacccacctaagctgcttctaaattcctgaccaacggaaactttgagataagaattgtgtgtaagtttgggggtaatttttaatagaataatacaggaaacaagaagcaaactcatttgttacattaaaaactttaaatactgacatatgtgctgttcagagggtatgaactggtgt

SEQ ID NO: 89066 - DNA, 1330 bp, Homo sapiens
ctagaattcagcggccgctgaattctagctagaattcagcggccgctgaattctagaacccgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89067 - DNA, 1028 bp, Homo sapiens
tctcttagcagaatagatttattatttgtattgcttgcagaataaagcctatccttgaaagctctgcatcatgggcagtgagctcagtggggctggacgcgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacttggccagtcttatctgagtctggggagtacatgaagtgggcccaatatcctcaccgggcgaggacgatgaggcccatccagggaggaagccgaggggagatgaaggcagggagctccagggggagcaccatggatcaccacggggagagagagaacaagaagcagaaacaagccctacgaccacggcccagacacggcacccgtacagagaggaaagacaggatggccgcacgcacgagccgagacagag

SEQ ID NO: 89068 - DNA, 1363 bp, Homo sapiens
ctcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89069 - DNA, 1683 bp, Homo sapiens
ctcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggcaaaaaaaaaaaaaaaaaaaaaaaaaaaaaaaaaaaaaaaaaaaaaaaaagggggggggcgccaaaagattccccctcggggggggccgccacaatattatgccgcagcagcccacggtgtttctgtgtgtgaaaaagaagggggggccccaataaaggggggcgcgtaatatatgaaccccgcacgagatgggcgcccggctttaaaaaaacgcggcggtggagtgggcgaaaaaacgcgtgataccggggcaaacctggggagaagagacacccccaaacacggagggggggagaccaatcgggggcaacacactacct

SEQ ID NO: 89070 - DNA, 1409 bp, Homo sapiens
ctcccggccccgccccccacctggctccgcgggcagccggagcgcacccggccggaagccgctgtcggggagccggcggtggggctggacgcaggtgaggtggcaccggactcagccgcgccctgggccctggatgttccgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89071 - DNA, 1311 bp, Homo sapiens
acgcgtccgcccacgcgtccggccggcggtggggctggacgcgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89072 - DNA, 1498 bp, Homo sapiens
tgactgccagggttgggcatcagccagcaagtgcccaggttctctgggtatcagccaaagtggggcaaacaagcaaacacagaccagccttagtcttctagaagtcagaagccgcagccctagcaggcgaggggaagagcacaaaacaggggactataagacatccttctcttattctccatactgtcttctacacctttaaagcctgcgaacctattcataggttcgcgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89073 - DNA, 1026 bp, Homo sapiens
acgctctctctgtggggctggccagggataggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89074 - DNA, 1593 bp, Homo sapiens
ctcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcagggtgagccctgaccccacagccctccacttggtggaggcctgccccagcccctccctcatgctcgctaccagggcagaggtgaggtgccccctcagagcctgtactgccctggaggtgggacaccaaagctctgaggggtgacttccctgtccctgggcctcctccccccacttcctcccatgcggccccgaccctccctgtccatggccctcacctgcctgcctctgcagcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89075 - DNA, 1588 bp, Homo sapiens
ctcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacgtggctggcctggcctgggtgtgcttggctgtgttcctggaaaaacaaacaccctcccatctcttcctggaagcctgcaccctcatatcagccaggccctggggccaccctcccttttgactgtccctcctgccatagtcccacccagttcctgcacttggcacccaaccctggggtgctggttccctccagagcctcctgacagcctggcttcctacagggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccaccatgggctaccccaaaacagccaatattggggtaactcgtatgcccagaggatgactcgacgttgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89076 - DNA, 887 bp, Homo sapiens
ctcccggccccgccccccacctggctccgcgggcagccggagcgcacccggccggaagccgctgtcggggagccggcggtggggctggacgcaggtgaggtggcaccggactcagccgcgccctgggccctggatgttccgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89077 - DNA, 861 bp, Homo sapiens
ctcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgcgtgtccactctgatcctgcatcccactccctgggagccaataaagtgcattttcacaggc

SEQ ID NO: 89078 - DNA, 1301 bp, Homo sapiens
ggcctggtggcgaattcggcacgaggggacgcgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89079 - DNA, 1369 bp, Homo sapiens
tctcttagcagaatagatttattatttgtattgcttgcagaataaagcctatccttgaaagctctgcatcatgggcagtgagctcagtggggctggacgcgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89080 - DNA, 1429 bp, Homo sapiens
ctcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggcaaaaaacaacaaccagcaaaaaacaactcacataaagacaaaaagacaactcacgaaaacaaaggg

SEQ ID NO: 89081 - DNA, 1531 bp, Homo sapiens
ctcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacaggtcctcgcgcccatcctgctgaggcccagccaggagtcggggagagggcccccaggggcgggtggggccggctggtcgggtcttcgtgccagcctcagtaagaggccagcggcagcctggggtgggatcgcgggcccaggacgagggcaggagacgctgtgcctccgcggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89082 - DNA, 1351 bp, Homo sapiens
ctcccggccccgccccccacctggctccgcgggcagccggagcgcacccggccggaagccgctgtcggggagccggcggtggggctggacgcaggtgaggtggcaccggactcagccgcgccctgggccctggatgttccgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctgggcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89083 - DNA, 1424 bp, Homo sapiens
tgactgccagggttgggcatcagccagcaagtgcccaggttctctgggtatcagccaaagtggggcaaacaagcaaacacagaccagccttagtcttctagaagtcagaagccgcagccctagcaggcgaggggaagagcacaaaacaggggactataagacatccttctcttattctccatactgtcttctacacctttaaagcctgcgaacctattcataggttcgcgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89084 - DNA, 1331 bp, Homo sapiens
ctcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacaggc

SEQ ID NO: 89085 - DNA, 462 bp, Homo sapiens
attaacctttctctgaaccagatcatttctgcaaggaaattctccattctggatcagcgatgccctggcgttacatgggcggtatcttagtgtgagaggtgagactgagtattcttgggggtccctccagcaggactgggcattcagtgtctgaaaccaggcctactcatggctgtgacgagtagtactgcctgttgatgccaatacgtgctgtccaaaacatgtaggcaatgttagcacatctgtactctgtttctattatggaatggatctagaggactaacaacgctgttgatcagtttgctgtggacagtgactttattgttaaaaatttaagattatctataatgaaagtctatatttttataatgagaaaaaaaggaaaacagtaacaggttattctattttaaatacctatgtgtatgcctcttcatttggaaataataaagattattctttctc

SEQ ID NO: 89086 - DNA, 615 bp, Homo sapiens
ggccccttccgagcccaccctgtggatacgtgggaacatgtcacaggcaacgctggccctggcaacagccttagcaagagagaattcagcaggaagcaagccctaaagcactttggactgtttcaaaaccctgtatctctgactgttctcactgtctccctcttgtcctacttcagctgactctgggggacccccaaggcattctcagatgaggccacaaaactggatgaattaaagcacctccgtgttttgtgcctgtggttcccttccacccccatgtgataacagtattcagtcccatgtccacctaaagcttaaaactgcctgttttggccgggtgcggtggctcacacctgtaatcccagcactttgggaggccaaagcgggcggatcacctgaggtcaggagtttgagaccagcctggacaacatgatgaaatcctgtctctactaaaaatacaagaaaattagccaggcgtggtggcgggtgcctgtaatcccagctacttgggaggctgaggcaggagaatcgcttgaacccgggaggcagacattgcagtgagctgagattgcgccattgcactccagcctgggcaacaggagtgagactccatgt

SEQ ID NO: 89087 - DNA, 203 bp, Homo sapiens
tttcagcaaagccagccaggaaaagcctcgttgagaaggtggcgtttgagcacagcctgaacctagtgaaggagagaaccatgtacgcaactgggaagagggttccaggccgaacggtcaacaactgtgaaaatcctagagcagtgaagtgtgtgagaaaatgaggcagccagagtgagcgaggtggagagcggtggagatgg

SEQ ID NO: 89088 - DNA, 293 bp, Homo sapiens
ggaacattattcaagaacatctgtgcaaattcggtaagaaacaaagtctggtcagcaaggtggaaattcccgtccaggctactgcagccaagaacgcagggcttccttctgtcaaaagacaaaattgcaagtttagtttgatgatcccagttggctttatttgcgattctagaatcggacaacatttcatttcatagaataagtgttccagtaagttgagcagaagagtttggcttatggacagaagggcttaagaagtctgaacagtgtattggttacttttaaacagaaca

SEQ ID NO: 89089 - DNA, 394 bp, Homo sapiens
tctaagctcctactgagcaactctatggttccttgtaagcactaaacccagcttggtgtgtgtatgtttctggtggtcactggctgagcaacgttatcagtgatgtgaatgtttttgtggtttttaataagcatttaacattgctgatcaaagaagctaatcaattttgattgctttcaaatattttacacaacctaaccagcaacttaagtgttagggtctttttcaattaagttgatcgtgtaaactgaatcttgtttcaatgtgtatgttttattggtttgtaagctaatcattttcccaggtatttgatatttctcctctactggtatttctttttatctgtcacgagtttgatattcaatgatgaaaaaataatttttgtctcctactg

SEQ ID NO: 89090 - DNA, 560 bp, Homo sapiens
cagaagccccctagaccatcacggatgccgagcttcgggtaactctcacagtggaaggttcccacgccgcccctaatcccgcttgaagcagccctgagaaacatcgcccattctctctccataccacccccccaaaattttcgccaccccaacacttcaacactattttgttttatttttcttattaatataagaaggcaggaatgtcaggcctctgagcccaagccaagccatcacatcccctgtgacttgcacatatatgcccagatggcctgaagtaactgaagaatcacaaaagaagtgaatatgccctgccccaccttaactgatgacattccaccacaaaacaagtgtaaatggccggtccttgccttaactgatgacattaccttgtgaaagtccttttcctggctcatcctggctcaaaagcacccccactgagcaccttgcgacccccactcctgcccgccagagaacaaaccccctttgactgtaattttcctttacctacccaaatcctataaaacggccccacccttaactcccttcactgactctct

SEQ ID NO: 89091 - DNA, 456 bp, Homo sapiens
tagtactactctatacatgtttgctgctgctgctgcttttcttttttaacctgagtaaccacaaaaggaatagaaataaaatagatgtcttccagaccagcagaactaaaggaatgaaaataagagaatgaagaaggctaaacccttggtataccatcagggtcagttggaataattttcatttttgattttcattttagagcagtgccaactatttagaagggtagatattatgacttgtattcttagagatctaccaaagaacaaagagaaaatttattttaaaaaattattctatcttacagttaccatatgagtccattagacccttttttataaacctaacatccattatgagatcttaataatcttggcttttcctatatattgaaatattttactactctaggaattttatcattacttatcaattatttatactgtgctaaaaaaaaa

SEQ ID NO: 89092 - DNA, 336 bp, Homo sapiens
ctctattacttatgattacaccatggcaatattcctttttcaccaggagctttggacctgcgcaggttgtggcatgtaatcacccggagcatgtagtcgtctgtagaaatcacaggcacactcatgtttgctctggaaggaatctgttttccacaatgactccccccagctaatgtacacactggcattttgcatgccttcctcacacatggggcaccagccttgctcagaaccacccaaactccacagaggcccttaatatggctagggacagatttcttaagaaagagtaagaagcagctacaaaggacaagcaaatccacaagtcaggcagca

SEQ ID NO: 89093 - DNA, 849 bp, Homo sapiens
ctacacccccaagacgctcaagttactccacagccagggactgcatctgagcatcgtcttcctactgtcaagcacagtgcctcccagaaaatgcactaggggttgaaaaaaataaatttctatcacaaggggccgggcgcggtggctcacgccggtaatcctagtactttgggaggccgaggcaggcggatcacctgaggtcgggagttcgagactggcctgaccaatgtggagaaacccggtctctactaaaaatacaaaattagccgggcgtggtgacgcatgcctgtaatcccagctactcgggaggctgaggcaggagaattccttgaagccgggaggcggaggttgcggtgagctgagatcgcgccattgcactgtagcctgggcaacaagagcgaaactccatctcaagaaaaaaaaaaattacatcacaaggctttggtaaatacagtcctctagaagtatgagcagccatagcatccctcctttttaattaacaaaaataacaggggcaaaaataacagcagcgctcgctgaccaagcgccagcatctatctgccaggcacatgctaaatgctgcactcttctatcgccgtccctgttaacagagttcaggaaacgaaggctcagcaagaactttagtccaacagctcttagctgccacagccaagacttgattcccatccgattcagaggcagagctccgaaccagtgctctcgcatgcaccgaaatgcaaacgctagcattagagtctcgctatacaaaatgctgggattacaggcatgagccaccacgcccggcctaatttttgtagtttttgtagagatgggatttcatcatgttgc

SEQ ID NO: 89094 - DNA, 585 bp, Homo sapiens
ccaaagtgttgggattacaggcatgagccaccatgcctggcctttctttcttttttttttttttccttttcaggagaagcgttctaaagtgccttctacagtttgtttgtttgtttgttttgagacggagtttttctctgtcacccaggctggagtacaatggtgcgatcttggccccactgcaacctccacctccagatttaagcaattctcctgccccagcctcccaacctctggagtagctgggattattggggcgtgccaatacgcccggctaatttttgtatttttagtagagatgaggtttcactatgttggccaggctggttttgaatgcctgacctcaggtgatctgcctgcctccgcctccaaaagtgttgggattacaggcgtgagttacccagcccggccccttctatagttcttttacagactttatttgcagcttactcatcactccctttcggcttgatccttaacgtgtggcactaagaagtcaatctagtactgggaacacatagttgggggccatctctttgactcggcgcgcttagtctaccaggcctttgtttgtaaggaatcaag

SEQ ID NO: 89095 - DNA, 354 bp, Homo sapiens
aagcaagggaatttcaggttggaaggactatgcagggaaaagggaaaataaaagagtctgttgagagccaatgtatgagagtctgactggatgaattcactggagaaattgaatactctgtacaacaacctctcaccacctccagcctccaagtgccatgccagctccatccatggttgtttatgagtctctagacagggatgaccattccatggttgaagccggtagatcagagaaggcacacgtaatgtttacctgcaaagaatatggcagaacctctcatgaagttttaagatcaaatggagaaaagttgcctgcagaaaagcatgattaaataaatttatagctggttta

SEQ ID NO: 89096 - DNA, 273 bp, Homo sapiens
gtagccaaacctcttcttagccacctcactgtctcaaacatgacctggggcagtgtgtccatctcgtgggaagctcaggagtctgcctttgatagctttcttatagaagttagtaattccgatcacccccatgagaccatggtgctgtctgtgcctggggtgtctcgcagctctgtcatcaccaacctcaaagcttcttctaattacactgcccaccttcatgggctgattggcgggcagcgtgctcagaccctgatggtccaagcaaccaca

SEQ ID NO: 89097 - DNA, 223 bp, Homo sapiens
tctctctgctctgggaatatctcagtccagttaaacagctgtgtctcatttcaggaggtggtggtgcaggtgggggtggggcacccccaaaggtgggtctttatgtgtgcaagcaatcaggcattgaatgagggcatttctatggatacaaaagaaatacaaagattaaccatcggtgctgactatagatcctgtttctaagttcagaggtccaatcttccgg

SEQ ID NO: 89098 - DNA, 710 bp, Homo sapiens
aagaaactttgaattccttacaaatgggactaatctagaaaatcagtcatttttttcctttttactagaaaatgactagtttttatttcagaatgagcttcaaggcagcgttttaaatttctccagatccagcctgccaacatttttgtgtaagatcaacaagcatttttaatgcacgtgcctattttgttgacccatccgttacccaaccacattaaaggattgattttagaggccaataatgtgaagtaaattaaaaggataacatggccttaattgctactggtttcaccgggcttctaggcaccggaatttcttgtggagaaacactttaagtgtcacagcagtttttgatcatgtggtctggctcacccagaggcttcaattatctcccagcccttctccacctcccctcagatatctctgagaagcaaagaaaatgtgcatttgtaaattcagtattatggacccctgattatttggcagggtaagaaaataggttctgttcattttacagtattcgcataggctagatgtttaaacaacaacaaaagacatggaatggaggagaacagtgggagtaagatcaaagcttttttcattaaaaagaattttgttgaattgagttcattctctcaaatgataacaagattgtgattactcttgggtgtcgggttagacacaacattgcacacgtagcttaagaaaag

SEQ ID NO: 89099 - DNA, 378 bp, Homo sapiens
ggaaataaagtaggaatcaggaggcattcaggatactggagctaatcagaagtcagcatggtggattagcttccaagatagagccccttttgtctccacactccacccctctaatccggctcttacaacctcaagcgcccacctcttccatgatgggtcctgagccagggggctgctgcagtcattttggggatgtgggtgacacattgcatcagtttcttttctacttgtaagcagaggctgcagcaacaatacaaacaacaggcaatgatacctgtgtcaagtatgagacacagaattaatcatgcctttgccaccatattttccagaatccaaaccaagaggcattttgcagggcagagcagcagcaggaacaga

SEQ ID NO: 89100 - DNA, 482 bp, Homo sapiens
tttacaattatcaatattgtaaaatatttttacattttctaaaagcaaaattctggaagtatgtgctgtgcactaaactgtgtctacctcaaaattctgatgttgacgccctagtccccagtgttgactgtattgcagatgggacctataaggcaataattaaggttaaatgaggctataagtgtggggtcctaatctgatagggttggtaccatataggaagatgaagaaacaccagagctcactctctctcactctccaagaaatcgacaaaatgggaacagagtattcaccaggaggcaaactggggggcaatcaaccaatccttgatcttggatttcccagcctcgagaactgtgagaaaatagattcctgttgtttaagccgcacggtttagggtattttgttatggcagcctgaggtgactaaaatagtatgtttatgcatttttcaaaagcaaataaataattctaatgtaaact

SEQ ID NO: 89101 - DNA, 311 bp, Homo sapiens
agagatttaagatccgagcaattgtacaaatagatggaactttgaaacaacttagtctctccagggaaaagagattagagaggagagcaagaggatttagaacagggccttggggaaatctttaatgttagggtgtgggaggaggaagagaaaccctgaagtagaagtataaactagcatgcttggctgtggaagtcaccaagtgccactccctccatcagctgttaattctgagccagatcacctcagttatgtagatggagagtggagaatctaggaactgaagatccttgtgactttctgccttgctt

SEQ ID NO: 89102 - DNA, 607 bp, Homo sapiens
gtaaatttatttgttaactaaaagccttatcatgaaagttttatttattccttcaagagtttttgtatttcttcaaaagggatttgatttctcctttgccgttgagagctaggagaccctaggaataggcaggacacattgcttagctgtcaagtcagcggaagatgagattcgtggaacttcaggcagctctggtggggagggacttgatggagtgactgccctgcttccccccatatggtctcacctcagtgggaggaagaggagcatctatggcccctccacactccccctcacttcctcagttgacaattgcatggccactagctgctatagagcacaccctacagtcttgggaacggctggcctaaaagcagaggttttcagatttggggggcctttatccctttaaatttttgttaagagacagggtctttccctgttgcccagctgaacttgaattctcagctcaagagatcctcttgcctcaggtccgagtagctaggtctgtgggcacacaccactggttcccgacttcctttcacattgtggccagaaaaaaaaacagactttcatgaaactgtatttatcctgagcatatctgatg

SEQ ID NO: 89103 - DNA, 437 bp, Homo sapiens
gtgcctcttacgatgtgggagcttagtaaataactgtcttttaaataaatgtccctttggtcattgtaaatactttaagaatagccatatattatctctacaatttaaaaaagcttttacattatctgatgggatcataatgactttcccatgtagggcagagaagtcagttactgtgtccaacttgtagatgagaaaattgtggctcagagggctcagacagcttgcctaaggatgcccaaatgttaaactcaggaagagaattttgttctcctgactttgctctgagggatttttacttagaagaaaccaaaggggaaaaacggtgtatttttttttttttttttgagatgatatattgaggaggagcatccagggttgaagtcaacttatacacgtggcaggcagactttggtttggctatggtctgcctttga

SEQ ID NO: 89104 - DNA, 222 bp, Homo sapiens
tgacagatttaaggcagagctccaaggataatagcagggctcagaaaatgctgactcaaggcatttcgaactcaataagactaagaggacttcagaaacaagaaagtcactctgatctttccctgcctttctgtgtgaagcatggtcataaaggaattctctgacctaccttgtctaaaagtctaagaccctcattccagggtggaatggtcctgtctcata

SEQ ID NO: 89105 - DNA, 628 bp, Homo sapiens
tcaagaccagcctgggcaatgtaagagaaccccaactctacaaaaaataaaaaaataaaaattagccaggcatggcggtgtgtgctactccaggaactgaggtggcaggatcactcgagcctgggaggtcgaagccacagctgcagtgagccgtcatcacaccactgcactccagctggggtaacagagcaagaccctgtctcagaaaacaaacaaacaaacaaaaccactctgcagtactggttctcagaagtggaggcacagtggaatcacctgggaattgttagaatctaccaatgcttatatcccacccagagattctgatttaatagacatgatatatagccaggttatcgagattttttaaagctctccatgtgattctaaaatgcagtttgaaaagctctggtgtaaaggacaaagttaaaacaaacaaatacacaaaaacgtcagatttgtcacttccaaaccagtcagtaaaacttggcagattcccagctactagctaatgctccttggagaagcttggcttggctgagtgtacatttgataatagccccataattgcttttcccatttgtttgattaatgtacctatagacaaggattctaggctaaatctccattc

SEQ ID NO: 89106 - DNA, 450 bp, Homo sapiens
ggccaatttgaattatataatttaatcctttgaagaatattgcaatttaagccagaaatttaataattatccgtttcttattttaaaacctttctggtttggtatatctcttgcttggcaatatttttactcatagttttgtagtaaagatacctatttaacattgtataactctgcatttcccaaaccctgttttccttgtcctggcaaaatactgttctagaaaagtagtcctagtgactcagtagatataggaagttggctgttggtatcagatactgttaaggaagaatctctatattcttcatttcttaaactttgttttttaaatcagtaatagatgtcgaattttatcaactgatgtttttcatgtaatgaaattctattttttattttgaattattcatgtggtaatttaggtgaataaatttcctgtaattaaccaaaaat

SEQ ID NO: 89107 - DNA, 151 bp, Homo sapiens
accatggaaactttgacaatgccgagaaacaatctggcaaatcatgtcaatttagatgagtaactgaggtccagagaggagaagtgatgtgcctaagaatgagcccctcctctgcactggggcctgtgcccccccagtggaatcagtgctg

SEQ ID NO: 89108 - DNA, 224 bp, Homo sapiens
ccacgtacacaaagacacacgctcactgaagccacatacaaacatctacggcaaccctaactgggacctcgcctatactagtaaatggaatggagctgctgctctcaagtttacaacgtagcttcgagtgcagttgggaagacgacacatacccaagacacaatataaggatccagcagagcaacttcaatcattcattcatccaaaacatttgggcgtacggg

SEQ ID NO: 89109 - DNA, 116 bp, Homo sapiens
cacaccatttgaaatcacgtttaaaaacttagtagtttttcaataaaatcatcacacagctgtagacacgatcttatttctctctgcctgtgcagaagtcttatgaaaattcaaac

SEQ ID NO: 89110 - DNA, 183 bp, Homo sapiens
agatagatcagtgctttataatgcaaggcctgattcgtttagctctgtgccaagtaccgagagcataaaaatgatgaacccttagtcactgacagctcacagtctcgagaaggcagtcccctagtcagacaatatcagagtatgtaaaatagccccaagtggtttatccttataactttattt

SEQ ID NO: 89111 - DNA, 480 bp, Homo sapiens
ggtttgaaggacaaaggagagggaagagtcagataggattagcacagcacatgactgcctaagagatgctcacaaaaataaatggctgaatgagtgaatgaacccagcggttttaaatctggaggcttaagacagtttttggtagctgagggagaacagaaatagctatgttcactgttaatatagaatatgtgttattctttgcgttcacctttcccacctatattgtagacgtcactgatagcttgtaatacttttctacctgaggtttaagtatgtaaatatgaggaattaataacaagttaaactcttgttttgaaaatctaatttgccaaatataattgaggaaatactataagaactaaatctctactgatcctctcttaggagcaatttgagataatttttctaagtttaaagacagactttaaagcaactttccagtcacaacttcaaaataaagtacaagttaattgcaaa

SEQ ID NO: 89112 - DNA, 167 bp, Homo sapiens
ataatccaagacatgcccagcctttgaggacttagatcctaaactaccttgtcttccccaatcctgtacactacaccacactctcagtctcctcctctgcttaactaagctccatctccactgacatctctgcctagtctcttaatccaatgcatagcctgcttatc

SEQ ID NO: 89113 - DNA, 707 bp, Homo sapiens
gccacttgctggctttgcagatcataagggatttagtagataaaggtggtgatatatttttggatcagctagccagacttggtgtaattagcaaagtgtcaacgtttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttaga

SEQ ID NO: 89114 - DNA, 333 bp, Homo sapiens
gtgacggtaccaacacacctcatggtaacataattgctcctaagaaagaacaaaataaccttgataactgatactgtgtcagtatggtgtgtgtgtgtgtgtgtgtgtgtgtgtgtatttcattttcaaccaccagcagtgggttgggatggtctaagtacagaaatgtgtatgatgataaacatgttgatgaaaagacaaaaagcttttggtcttgggtggggaggagtgtgagtttggaccctgcttggtcattctgctctgatggaggttcccatctccttggtgatctgcagcagaaggaagtacatgctgaatgttgggtaaggggag

SEQ ID NO: 89115 - DNA, 208 bp, Homo sapiens
ctaattctgattcctcattaacttttctagattattggagagaaacatacactttccgtttcattctgtgatgttagcattatcctgatatcaaaactagaataagattttatgagatacctcagtctccatgaagtgcttatttcacattgcatgcctgtatcaaaacatatcatgtaccccataaatatatacacctaccattacc

SEQ ID NO: 89116 - DNA, 125 bp, Homo sapiens
  misc_feature (52)..(52): n is a, c, g, or t
gtgttgtatgaaaggagagaaggttagcactccccttgacaaggatggaagnggccctcgggcctgacaacacgcatacggttaaggcattgccacctacttcgtggcatctaaccatcgttttt

SEQ ID NO: 89117 - DNA, 346 bp, Homo sapiens
atgcaagtgtttccaaccttgcccattctggctggggctaagaaatggattcatcacctgaaatgccgtccagtctccttgctgtggacaacagggtcctttcaaggtctggctccttcccagagctccagcctcccacctaccattcccactcagcacagacaccccagccttgttcttggtcttgccaagcctatgtctgcctcaggggcttgacacttgctggaacacttgaccctggggcctttaccaggctcactcattcacttcttcgatgcttctgttcagagggtcatcttctgaccagcctgtctccaagacttgtccctccaccaccactgtactc

SEQ ID NO: 89118 - DNA, 429 bp, Homo sapiens
tatctaagcttcctgactcaggtgatctgcccaccacggctcccaaggtgctgagattacgggcgtaagccactgctctgggcctctgatttttatacctctgtaatgccctcttgaatcccttcttctctttctattttcgttgtgactagtcctctggccgctcacctggaaaggcagaggagagggttgtaactctgggagttgaattataactaatcttctaatgatggtgtttaacaaaagccatgttaaaggcaaagtgcttctgtttcgaaaaatactctcaaacccagttttctcttggccctcacaccacctcagcagcaatcaacaacaaagaagaagacttctttgcctaaatatgcggggaatttcccgactcacatagcagcagacaccagctggatgtcctccaattcagttccg

SEQ ID NO: 89119 - DNA, 513 bp, Homo sapiens
caggagtaattttttggtagccttgatgaggcctgagggggtggcaactgcccctcagtacaggaaggaatgccttgtgaaactggtcagctgtcatggtgaaactgcaaaaaagaggggagctggtcccaatgtcaggcagttggctgaagtcagcagaggagcaagtcttccaatctttgtttttccagggctggtttctgttcaacttgtaggaaaaaagtctggtattggttagtaaggaaggagaccaggaccaacccctcatcttgtcatgtttgggaatcttagtttttcatgtttttctggggtctacttggtcgaggggggttctgttcagccagtttagggggcttagaattttatttttatttcacaggcacaaccagcacagctgctttggtaagtcagtgacattaaaaaaagaaatgtgtggcagggcgcgatggctcacgcctataatcccagcactttgggaggctgaggcaggaggatcacgaggtcaggagatcg

SEQ ID NO: 89120 - DNA, 780 bp, Homo sapiens
ggatcaatgccgtgagcaagaacctggtttgtcctcagcccctcctaggggtccttacctaagccctacagggccctgaggcatgggcccagaagcattcctgtccccttttgctaagtgaagaaggtgatgcttatctagaactcgccacaggtggagtggagaagaaggatttccactatatgtgggctttctccctgggtggggcaccacactgagggctttatgtgaccacctcctttaatctgtgtgtgctccctgggacagaaccgttttactagaaatgaacaaaacacatattcacttgtgtgcacgtgtgtgtgcaaggcagagctgcaagagcacagggactgaggtggggtagagtgggctctgtactatggacacgtgtgactgaagtgggatagagtgggctctgtattatggatacgtgtcactgaggtggggtagagtgggctctgtactacggatacgtttgataagctttttctttttctttaagagctttatacggttcaccctttaaagtttacatttcagtggtctttaggatattcacagagttgtgtggccatcaccaaaatctaattttggaacattcattaataaataaaaagaggtgcagcttccctgtgttgcccaggctggtttcaaacttttggccctacgccatcctcttgcctaggcctcccaaagtgctggggtcacaggtgcgagccaccaagcctggcctaattttagaacttttttttttgagacagggtctcactctgtacccag

SEQ ID NO: 89121 - DNA, 474 bp, Homo sapiens
gatggtcctaaagtaatcggctcagctaaaaacacacttataacagttgggcatgtcagctgaggagagacccttatagcctgtgtttcctacaaaaacaaaaacacagttcttttatgaaagtagacaagttgatggtatatttgggctaaataaaatacaatgttgacatatgttgaaatattctatagttgttacacatgttggctgaggtggttgtactgatccagacacatggctgatactttgagtgggaacatagccagtgtggttttaaaatattatgtccctctgaggagggattacagatgattttttgctttctacttacacctttttataggtttcttacaaaaatattgcgcatgcagtcttcttacaattagggaaaaaacccaagacatgctctaaggtgagatgagtggggggaagaaatctgtatacagtcagccctctgtatccaaggcttctgaa

SEQ ID NO: 89122 - DNA, 424 bp, Homo sapiens
aatatgctcagtgtttcttctagctccttggccatatggaatatagttatgaaaactgttttaatatccctgtctactaattatatcatctgtgtcatttcctgggttggtttcaattgactgatttttttctccctcattatgggttgtatttccctatttttttgcaacttggttatttttggttgggtgccagacattgtgaaatttattttgttggatgctagatagttttgtatcactataaatattcttgaactttcttcttgaatgtagttaagttactgaaaacagtttgattctttcaggtgtcacttttaagctttattaggcaggactggaatagcatttagtctaaggccaatttttttcactattaaagcgagacctttctgagttctttactgatgccctatgaattttg

SEQ ID NO: 89123 - DNA, 573 bp, Homo sapiens
catggcagcgcttgtttgttttgatgttactatgtgttaaatcttaaacaaatttcttgcagccttacgccaggtttttgttgaagcctactgttaacccagacaatgactccctcctgcaaagagcgtgcggtggcagctttaaaatattaatggaggcatagcgtgcacaggcgggaccggaccacgggcggtgggagtggggcccggtagagccatggacagcgaatctcccagcgcctcctcgagcctggggaggggcccatgccatgggtgcctcaggacccctggggtcaggctcagctgctgcctccccaactgcaccaaacaccaccagcctctgggcgagggtctgccagccttgctcactggccccctatgggtccatctagctcaggtgggggcacccagccgatgaggcagaggaaggagggctgggctgcggtctcagctggctgggagccctggcctcccccaggacccacgcttgtgtgctgggtgtggtgtattttcccaagtaaatgcactgacgtttcctatagacacctgggtggatactgggtggtggcttgg

SEQ ID NO: 89124 - DNA, 871 bp, Homo sapiens
actccattgcgaggcgtttcgggccacgaagcaggaccgggggccgcactccgggtccccgccctgccctcgccgacctcccgcgcgtggaagggggacggcggcggcggagctccccgccacggagaaccccgaaatggtcatttcgaacgagaggagtgtggcctggggtgtctggtttaacagccccccgcgccgaaaggctgttcgccgaggaggggccgccggggagggagcccgagcgcggcggggcgagaccggtccccgcccggcgttgcccggcccgagggacggcggcgcccccaggaccctccccagcgcggccccagctcgctccgggaccgcggggccaggccgggcgggagcgcggggacgtacacggcggccccgcccgcgcgctcctcctccctcccggcccgccctgcgccggcggcggcggccccagtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcaggtaaaactccgcatgtgtggctgagacaagctgcagcagagtctgcttgagaagctgacgggagactttg

SEQ ID NO: 89125 - DNA, 361 bp, Homo sapiens
aatgacagatccattttcagtttgttcagacagttgaatatattataatttacatcgtgataaccaacaactgttatcctcaacagatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcaggtaaaactccgcatgtgtggctgagacaagctgcagcagagtctgcttgagaagctgacgggag

SEQ ID NO: 89126 - DNA, 3135 bp, Homo sapiens
actccattgcgaggcgtttcgggccacgaagcaggaccgggggccgcactccgggtccccgccctgccctcgccgacctcccgcgcgtggaagggggacggcggcggcggagctccccgccacggagaaccccgaaatggtcatttcgaacgagaggagtgtggcctggggtgtctggtttaacagccccccgcgccgaaaggctgttcgccgaggaggggccgccggggagggagcccgagcgcggcggggcgagaccggtccccgcccggcgttgcccggcccgagggacggcggcgcccccaggaccctccccagcgcggccccagctcgctccgggaccgcggggccaggccgggcgggagcgcggggacgtacacggcggccccgcccgcgcgctcctcctccctcccggcccgccctgcgccggcggcggcggccccagtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcagaggacatcctgggcgttcaggccgcgcggccctgggagttttaccccagcagctcctgccgctcggtgctcttccccctgctgatctctggttccaccttctggctgctcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcgaccctcacagcagcggtgtttgtggccacggacagctggtatttctccagccccgcgacatccaggaaccttgtcctgacacctgtcaacttcctgcactacaacctgaatccccaaaacctggcgagacatggcacgcacgcgcggctcactcacctggcagtcaacggcttcctgctcttcggggtgctgcatgcccaggccctgcaggctgcgtggcaacagctgcaagtcggcctccaggcctctgcacaaatgggcctcctgagggcactgggtgcccggagcctgctgtccagccccaggtcctatctccttctcctctacttcatgcctctggccctgctatctgcctttagccaccaggaggctcggttcctgattcccctcctggtccccctggtcctgctttgtagtccacagacgcagcctgtgccttggaagggcactgtggtcctcttcaacgccctcggtgccctcctcttcggctgcctgcatcaggggggcctggtgcctggcctggagtacctggagcaggtggtccatgcccctgtgctcccaagcacacccacccactacacactcctcttcactcacacctacatgcccccccggcacctcctacacctcccaggcctgggggcaccagtggaggtggtggacatgggggggactgaggactgggccctgtgccaaaccctgaaaagcttcaccagacaaccagcctgccaagtggctggtgggccatggctctgccgcctctttgtggtaacccctggcaccaccaggcgtgccgtggagaagtgcagcttccccttcaagaatgaaacacttttatttccccatctgaccctggaggatccaccagccctgtcctccttgctgagtggggcttggagggaccacctcagtcttcacattgtggagctgggggaagaaacctgacaatatgacagagcacccactgcccaagactcagccatagaagatgccgccccaccttctacttgggtagctgggctgggacgctgggacaggaccccgtcctccttcatgactcccactgctgcctctcctgggcatggctgttagctgttctgccttctgggtgagctggcactcttctccctgagaccaaagatttgacctgtcggtcttgatgtcaaggtccccaaagaccaggttaagtgacgacacctgtctgttcctgccctgttgcttccagccactgtgatgtttgaaatatgtgatagtacctggttgtgaaaaaagacaatgaactgctagtgacattcctcaatgacctctcccaaacctcccatgatgccttacccttgctgtcatgacaaccctctggcttcctaagacccatctgcctatcgaaatatgtgcaagtcagtgagacgaagtatagagaacaggtggcccagatccaggggacccaacttctggccccttggtctgtcacctcctcgctgtgtgatcttgagaaagctccttccactcacccaccccacttcccagtctgttgggatcagaggaactttgaggtgtctgccggctaacattgtgtcattcctggagtccacagtacacgtcccctgcctcaacaggcacagctctcacaaagctcttcaagcatggaagtgggagttgtgttgtacttcatggcactctgatgcctgctgtctcagtgtttggttattatgcaaacaagtaatgtttgaaatatataatagcactggaaatt

SEQ ID NO: 89127 - DNA, 597 bp, Homo sapiens
gcggccgccggtcaggattcgcgacccgacatggagcgtccccgcagtccccaatgctcggccccggcctctgcctcagcttcggttaccctggcgcagctcctgcagctggtccagcagggccaggaactcccgggcctggagaaacgccacatcgcggcgatccacggcgaacccacagcgtcccggctgccgcggaggcccaagccctgggaggccgcggctttggctgagtcccttccccctccgaccctcaggataggaacggccccggcggagcctggcttggttgaggcagcgactgcgccttcttcatggcatacagtgggcccctgaggttccaggtcctttgcggcggcgatctggagggcgtggctacaggacccgggatgccattcagttactcatcttttatgctttcgtcctgacctgtctcaactagacttgctcctgcaaccaccatgggggttttgcatttacatttgtggaccatgttacagttaagaaaaatcctgtttcagtccttatatgtaataaaatgttttatgatgtaacttggccccagaatgattttgaagatacattaaaggaaagccc

SEQ ID NO: 89128 - DNA, 911 bp, Homo sapiens
gcggccgccggtcaggattcgcgacccgacatggagcgtccccgcagtccccaatgctcggccccggcctctgcctcagcttcggttaccctggcgcagctcctgcagctggtccagcagggccaggaactcccgggcctggagaaacgccacatcgcggcgatccacggcgaacccacagcgtcccggctgccgcggaggcccaagccctgggaggccgcggctttggctgagtcccttccccctccgaccctcaggataggaacggccccggcggagcctggcttggttgaggcagcgactgcgccttcttcatggcatacagtgggcccctgaggttccaggtcctttgcggcggcgatctggagggcgtggctacaggacccgggatgccattcagttactcatcttttatgctttcgtcctgacctgtctcaactagacttgctcctgcaaccaccatgggggttttgcatttacatttgtggaccatgttacagttaagaaaaatcctgtttcagtccttatatgtaataaaatgttttatgatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaacaaaaaaaaaactcaaaaaacaacacaacacacatgaaccccccttccccccgcaaccaatgcctttcccacactttaatactcccccccacatccacccccacttccctcatcacccccttcatccactcttaaaccaaacacctaccacgtttccaccaaacatcgaccctccctaggacacccccaccatatacacccttcccccccctttttcccgct

SEQ ID NO: 89129 - DNA, 1372 bp, Homo sapiens
agcggagctacctgctgagacagacaaggagagggtttcctgtgatgggatcagtcagatgcctgcctggccactccccctgaggggacctgggctcctcttaccattggcaggccggtataaacttgcggctcagatcaagctatgcctgatgctgccttaagccttatgaggtcgccaaggaaccgcaggtgaggattcaggagataattctgcaaacagaacttcctgagaactgagatgggggaaatcgctggtattagaagagtgaaaagaaactcctggagggcagaggcatgcctgccatcttcatcaatgcattaccaccacccaacactatcgggggacctgccctgataatcagtctacaggtgtatccagcagctccagagagacagcgaccagcgagaaggggccatgatgatggaggtggttttgtcaaaacgaaaatggggatatgtagggaaaagaaagagagatcagactgttactgtgtctacatagaaagggaagacataagagactccattttgaaaaagacctgtactttaaacaattgctttgctgagatgttgttaatctgtagctttgccccagccactttgccccaaccactttgacccaatctggagctcataaaaacatgtgttgtatgaaatcaaggtttaaggcatgtagggctgtgcaggacgtgccttgttaaccaaatgtttgcaagcagtatacttggtaaaagtcatcaccattctctcgtctcaataaaccaggggcacaatgcactgtggaaagccgcagggacctctgcccttgaaagctgggtattgtccaaagtttctccccatgtgatagtctgaaatatggcctcgtgggatgagaaagacctgacggtcccccagcgcgacacccataaaagatctgtgctgaggtggattagtcaaagaggaaagacttgcagttgagatagaggaaggccactgtctcctgactgcccctgggaactgaatgtctcggtataaaacacgattgtacatttgttcagttctgagatgggagaaaaaccgccctatggtgggaggcgagacatgtttacagcaatgctgccttgttatcctttactccactgagatgtctgggtggagagaaacataaatctggcttacatgcacgtccagtcatagtaccttcccttgaacttcattatgacatagattctattgctcacgtttgttgctgaccttctccttattatcaccctgccctcctactacattcctttttgctgaaataatgaagataataatcaataaaaactgagggaattcagagaacggtgccagtgcaggtccttagcatgctaagcgcaggtcccctg

SEQ ID NO: 89130 - DNA, 427 bp, Homo sapiens
gcccccactctggaccctgcttgggttcacagcattggtggaggtaagtagtattctcaatgtattgttagttgactttcattttgcttaggaaatgaggtttctgtatttttctgatccagtactagatttttttttttttttgagagtcctgatgatatttaactgggctaacgaacagttagtaagttcttagcatgtaatacaaaaaagtgtttgtaattttggcatttgttcttaaattacttgatacttaatatgttttctttcctataggtggggttgtcattgtgaaatttaagatcttcaaagaagagaatgtaatttataccatgaatatgttattttttcatgttggagcactgtaatactttcagtttgttttcttattgtttaaataaaatttttaattcttatattaagtgat

SEQ ID NO: 89131 - DNA, 294 bp, Homo sapiens
cttgaacccgggaggtggaggttgcagtgagccaagattgcaccactgcactccagcctgggtggcagagcaagactccgtctcaaaaaaaaaaaggaacaatgtctattcttcccaatttattatgagtaatcccaaggaggggggaggggtttaaaagtagaccaactgattttgaagttgatttgtaaaaataagtatctaagaatacccaagaaaacttgaaaaaagaatcatagtgtgaagcgaaatatgtcctatttgttgttaatgtactataaggcacgataatca

SEQ ID NO: 89132 - DNA, 525 bp, Homo sapiens
gttgtcagtgttgtgcagtcaaaagactaagaagtatctatagcacagtaaatgtatttgcatatagtaattattgctctgtgaaattgctgcttttgtataagatacaaacaggatataaagcaaagaggcaacatacagccttgagtccttagagaccttaaattggtgagtttgtcttctcatgcatatgccaatttgtgttgtaagcaatagggactgtctaacaaattgagaaaatacactgtgtgtgagttgttttggaatgtgttcttatatttgtcttttgtatgtattttctgaaatgtatacagttcacattacttaaagcaatgaaattatacctgtaagactagattcaagaggagctgaaaattgttccaactttcccatcttgagtgctaatagtttcttattgacaaaatttgcttaggggaatttaggacagtaaaaaactttgatcacattctcttcttaaacctatatctaaagaagactatcatatttaccagctgaagtttgaaa

SEQ ID NO: 89133 - DNA, 338 bp, Homo sapiens
ctaattgagtctcccgatctcttctcacccacactggctcatgctttcaggctggatttctgcctcagtcactcctttagtcattgaatacttaattgcctagcatccgagacctacaaccactgctctctttgcccctaaatcacagactaaagggtagatcctccttcttgcagctagaacttcctaaagaggatctgacacttgccttgctggatgtgtgaataccatgcactctcggctcctaaaagaaggctcagccctcctgggatcccctatatcatctcaggccccagacacccaccattcgcctgaagctgggctgtggaggtctttct

SEQ ID NO: 89134 - DNA, 538 bp, Homo sapiens
tatgtggagagggcacgcaggcagttggagacacgagttcagggagcgttctaggctgtggacgtagatttgggagttggtggtatgtaaatagaatttataaacatgagactgagtgaaagcatcatagcagagggaatgtttaaagaagagaggaggcctggggatgtttaacgcttagaggcacaggtatgaggagcctgtgaagcagaatgagaagtgtcaccaattgaggcagaaggagaatagtgaggaagtggaagctacagaagaaagtgtttcaggaaggaaggagttaccagctgtgacacatgtggtttaggacaagtgagttgagccttgaaaattggccattggcttcagaaaagtgtagtagttggtgaagttgaagaaagctgcttttagtgtggtgttgggaacaatgcctggcagaattgggctcaagaaacaatagaacaaggcaaggtggagacagcaaatacaggcaaatgtgttgggcagatattcaggtggttaccaagtaggcaggtagaaaaac

SEQ ID NO: 89135 - DNA, 321 bp, Homo sapiens
gtctgctctgtcttgagctatatcgcatccttggtcacttagtagcccaaggcctaatctgccatccttggtcacttagtagcccaagggctgatgaggccttggcgtatctggtctacttcctgtgggagtcagggccatgcaaattagccaggtccctgctatgtcgtggggctgtaagcgggtacgtgggtgttccaggagctacctcagtgtttatcttgaactcatgcatagcatggcactccatccgtcgaaggcctctcctccaggggcagctctgtctcaccacccccagctcctttttaaaattttttttta

SEQ ID NO: 89136 - DNA, 167 bp, Homo sapiens
tctacttgcagtgcttgagcatgtcacgtaataaactaccttgaattaattgaagatactttccattaatctttaatagtcaggctgttatgataatgtggtaaatcataatttggagatctgtctcagaaaaaatattatttgaatctttactcaccttacacaca

SEQ ID NO: 89137 - DNA, 249 bp, Homo sapiens
cacgtgggaggggtggcagtcacaggagcctgaggggggaaccacatcccaggaggaaccggagtctcatggacatgctgagacctcagatcctatcccaagagcagtgggaagcatggggatgcttcaggacccactctgtagccttccaagaatgaaggcttctagaacatttttttttctttttcttttttctgagatagagtttcgctctcattgcccaggctggagtgcagtggcgccatctcg

SEQ ID NO: 89138 - DNA, 543 bp, Homo sapiens
ggataagcaaagctcaatggagagaagggataactaacaaagtttgatttttgtaaattaagcttcattatcttctgtatcccacattccaaatctcacttaaaattcaggccatatttttcacattcgcccacatatcttcagatttgatacttacctgcttacagagtcacagaagccagtgagcctgtccagggagtgtgtgcagactgataacacaagagagtgaggcccaggttcaaatagcaattaaaggggtgtcttcaaaagagttaccaatgcagacagtgggaaaaggtggtaaatgaggagccaggagtcaataatctccatgtatgttttagaagaaaatcgttacaaatatggagtatcctcttgttaaatgcgtttgtgaagtcaaggaaacttgactaggaccgaaactaattttggaattgatctttggaattgacagttatgaattcactgtgaaatgggaggcagtggttattttagagtaaaaagaaaaaaagggtagacaattaattcaagaaatttggtaac

SEQ ID NO: 89139 - DNA, 459 bp, Homo sapiens
gagtggagacatttaaagaattgaacttgattccaaattgagattagtttggggccagtatcaacttgtattgatagatttttttttttgagaaggagtctcgctgtcgcccatgctggctccgcctcccaggttcatgccattttcctgcctcagcctcccgagtagctgggactacaggcgcccgccaccacgcctggctaatttttgtatttttagtagagacagggtttcactgtgttagccaggatggtctccatctcctgacctcgtgatctgcccgcctcacctcccaaagtgctgggattacaggcatgagccaccgtgcccggctgtgttgatagattttaaaccacaaaactggttgtattttaaaaatgttaatttgtaaatatagcatctagtattctctcctaaaacgatatattttgttctgtcttctgtaagggatttgagatt

SEQ ID NO: 89140 - DNA, 447 bp, Homo sapiens
gtggtgccagccccctcttccctggcaacatcctgtctcaggaggatcctcttgggccctcccttcccttggcggggcaagggggtgatgggggggcacccactcaccaacacagtggccaccctcactcccatctctcttgaccattccaatcttatacagacagggaggagtggggagtagggggaaggggagctcacagcagcaggaccaattcttccgcctctactagggccatggggaagggggctggccctaagcttccatgatctctttaggaggtggtttatttagcatctttgtccacagctgtggccctggtaaccaattctggggcaaccggaaatgtccccgctgcatccccttggttatggtgagccttcccttttggaacatgtgacacgaaaccagcagcctggcgttgctagtgcctaggaaaatgcccgg

SEQ ID NO: 89141 - DNA, 297 bp, Homo sapiens
acgtgcttgtgctgagaaaagatgtcaaagaatcaaatcaacagtcctccctttcccgtgacaaaagggctaacagaggccctgaacaggttttcctttggccagttgccaagggactcacccaaccatccacctacaaatgtgccgcggagccttctcactgggagggctccagcgagggtcacagccactcttcagacaaaaagctctgttcccaaagaggctcctgccagaccgaagctctgctgttgagacacacgcttcatggctctgaaatccccgcagagaataccctcc

SEQ ID NO: 89142 - DNA, 553 bp, Homo sapiens
cctttcccttttggaaaatttttttgtaccttcatatcacagctgaatagttatcaatgccatttccatttggaagtatctaaataaccacaatgtgatcacagcttctccacgagccttcctgaagtaaagctggtatgcttgctataatacttggaacctgttgctttctcttcctcactctttaaatgtcataaggtcacacagttcttggaatcagaactattcagttatttcttcatgattctgcctggctttctgagtcttctcattcggcatgttatgtaaaagtctgaacaacaatgatgacgcagacgagagcaacatacgtttttattttttgataggtttttatttttttgataccagagggaattaactatgatcacatcgtgctctctctgttcagcatcacacgcccacatactgcagtgtgggagtagattggtacttactgagcacttagaaacatcacgcatcaggaaccgggtcagggtgacagcatcctacggtcatatcatgaaggaagcctcccttacaaacctaaaaaaaa

SEQ ID NO: 89143 - DNA, 338 bp, Homo sapiens
caatctgaataaccctgtaggtatttaagaaattgagttcataactggaaatctcgtaaaataaatcgtcaggccaagatggcatcattggagaattctgtgaaacacttgaagaaaaattaacctcaattttatataatgtatcccagaaaacagaagaggaaatacttctcaacttattttctgaggttaatattaccctgataccaaactagataaagataatacaaaaaaagacaactgcacatcaatgtcttgaatccaggaggcagaggttgcagtgagccgagatcgcaccactgcactccagcctggatgacagaacgagactccgtctc

SEQ ID NO: 89144 - DNA, 310 bp, Homo sapiens
ttaaaacagtcatggcttagtctagctaatttgaattcattatggagaggttgcatctaatttttgtaaaactatgacatgtataactcctgaaaagaggcttaactttctagcaagggcaaaatgggattacaggtgtgagctaccacgcctggccctctgccaccagattatatgcatctcctgttttgaccaagtttaagttggaaccatgaagagaaggggattctgtcaagcatagttcctagcttaaccaaatggactcagtacaaacccctacagtccaccctttgtcaacctgacatctgtc

SEQ ID NO: 89145 - DNA, 465 bp, Homo sapiens
agtttgttggaatcagtattcaaataatgtgcatacattatcactatctgacagatctcttaagcctcttttaatctacagcacaggttggcaaactactgcccataggcaggctggctggctgcctgttttataaataaaagttttgttagaacacagctgcctatagattgctttaggcaggaaggaccttaaaggcagggcctactcttctttcttcctggctctcccacacgcagcccagaggccctcaatgcctgcttggagattggaaacatgaaggtttggcttaagtgggagttcttaatatgtagcagcctcctctttcctgcctagtcaaagaaaatagtttaaattgatttcagtttgcacagctaattttttattttaaaaagtgtttaacgacatgactctgaatctgagggcttctggttgttttttgctccttccctcttcagcttggtt

SEQ ID NO: 89146 - DNA, 733 bp, Homo sapiens
gacttacttttccacagggacttacttttccacagggacttacttttccacagggacttacttttccacaggggatccctctcactgtggtttgccatatgctccacactgcgtcttatcccaccaatgacaccaccaacacaataggtctatagaataatatggcccaagagtcagagctccttgcactgcatctgaaacctgatccagaactcttttctgttttacataactctcaaatctggcagacttccatgttacctggcatataggctggacgagcatcgtaagtgtagaatgtgttccctccgaaattcaaacaaccttttgttcaggtatcgtgcttttttcttaatggtagtgagtataagatgcagcaaactaattattacttggaggggatatctcagtgtaccccctgactactgggctcctaaaaatgttgctgaagagacaggtccttgaattgttgtagggtttatttctctctttgtggagtgcatgattcctactaatgcaaacagcacattagccaactgtgacttttgcttctctatcagcatgatttgatggatataatggatcgttgtgatgttctgctagatgtccacacactctagaagttttggactatgttaaaatagtgcataggaaaacgaatatggagttgggtgtaaaactgtaaaaaatataattccctgttgcatgtgaatacatgctcttccttatcctt

SEQ ID NO: 89147 - DNA, 326 bp, Homo sapiens
cgattctgcttaaggaatatttacaaccttagattcataaaaatatcctgtactgtaagcattgaactttttatatatttgtgaataaacaatttaccagccccatttactgggcagcctatctttttcctattggtctgcaatgccaattacatcacatatcaagttttcagatgtatgtgggtctgtttttgggctcttccttctgtagcatctgaatccttaatgagatttaatattccatttgtgaggaactacacctttattattttaagcatactgctgtactatcagtatcactgaatcagtctatcttttagtcaatc

SEQ ID NO: 89148 - DNA, 501 bp, Homo sapiens
cactaagaaacatgagtttaggaatcatcatagatgattgtttttaaaaactcaattatcattgatgaaaacaggacttcaatttgctattggttcatttaccatcgatattctctataaagattttttttttcagcagccatgtcccaggctcagatcctaataatgtcagcactggatcttgtgtgtgtgttaccttaacacacacacaagatgtgttatcttaagccagtgtgttatcttaagccagtacgaggcaatacacacagaaaaaaataattttgagaatagatctgtttgacaacacctgacgtctttccagtgggggttgcggggacgtagggaatagcagtgcaaggtctttaagatagtgtctaaaaatctaagctgggctgggcatgctggctcatgcctgtaatctcaacattttgttaagccaaggcaggtggatcacaaggtcaggagttcgagaccagcctggccaacatggtgaaaccccat

SEQ ID NO: 89149 - DNA, 365 bp, Homo sapiens
ggagaatgatgcctggagcagcagctgaaataagacacacctatcacttgtctttgtgtgttcactttccctttaggtctttaataccttgttactcagagtgcgctccaagaagaagctgcaccagcatcacctgggaacttgttagaaatgcagactctcaggctcctcctcagacctcctgaatcaatctgcttgttattcagatcctcaggcaattcctattcacttcaaagtttgagaaccaccattctaaagaattgatagaggacttgcagtgttctttaatgactgagccctctagctttgccatttcactgtctctaggacagcaagatttttggaagtggggtgggtatcatgct

SEQ ID NO: 89150 - DNA, 301 bp, Homo sapiens
tgcctgattgctcagtgatcaatcattttgacctcctgattaagtgaaatttgcatcggatctatcccacttcctactgtagagtataattaatcttgaagactgtgagccagagggcctggaggctcctctgtctattatctgagtgtccttgggcagttatttaatacatttctgctcccccagttttcactctgtacagtggagataaggttgttgtgtgaggactaatgagtcctaaaatattgccttacgattaaaattactttcacagactatttgcagcattaaatataatagg

SEQ ID NO: 89151 - DNA, 428 bp, Homo sapiens
actgtcaccactgtggaataagaattccgggaagaagagacttagatacagggtctacagctgtctgttcccatgccacggaaggttcttccagccaccttgttatggcgatcctcctggcagggaatgagagccatctccactgcctccctttgagtggttatctggcttgtgttgcttgtcttgtcgggagaccaagggccttgcaaagtaggtgcctgtgaagagtgtcagctgaggccctgcagggagctggaagcttggaaggcctgggagaaaatgcctggctaatgtatgaggcctggaagactcttctttgttaagaagattcatgggtctctgaggagtggagtaatcaggactaggagaagatgttgggccaagccttcgtatcctatatccatctgcttgaacattttttttttttt

SEQ ID NO: 89152 - DNA, 598 bp, Homo sapiens
acatgaatctatgaatggtctgcaaaccacttatactccaggtttcaattctgctgccagtaataatagtaataataccatcattctattctagtagcacagtgcaaatttaagataattagaagatgatgatagaaatttgaaagcaatggattacaaaacaagactgcatcaaagcataacacgcaacacaacactttttcaattatgtacataacctggaaaaactagttggcaatgaaaaaaatgtgttgagaagtaccttattaattcattaaatatttctgtaatcctatgtttctttaaaaagaaaaaaagattactagtctaagtgagcttttatctttgttaagcagcatccttttaacctccatcatctctaataactaaaaaaaaaaaaaaaaaaaaaaaaaaaaacaagagaagttaaagaagcaaaccagcaagagaaactgtagttgctgtatcaatgacaattattccagtgataatgacctgactttttgggttggtcttctagctagtccacagggatccactgttcaggacggtgttaggggaggtgggctttgtcattttgcacaaggtttgacaggtt

SEQ ID NO: 89153 - DNA, 4695 bp, Homo sapiens
  misc_feature (320)..(320): n is a, c, g, or t
  misc_feature (374)..(374): n is a, c, g, or t
  misc_feature (4445)..(4445): n is a, c, g, or t
  misc_feature (4479)..(4479): n is a, c, g, or t
ggcacgaggccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagacccgtaggagcaggaaatccacctgactgtgattccccactggcctctgccttgcctaggtcatccttcagcagctcctcagagctgtccagcagccacggcccggggttttcaaggcttaatcgaagagatggagctggtggctggacnccacttgtgtcaaataaataccaatggctgcaaattgaccttggagagagaatngaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggagagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttactggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggttaaccagagcacaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcagcgggggcggcgtccggctccccggcgcgggaactggctccccgactcgcggggggcgcaggtcgttctggaccagcggatgagggagagcccttggttaatgcagacagaagagactctgctgtcatcggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcacacaagcaggtgcagtgctgtcacctggctgaagacctgcagcctcggagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatggctataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattangtttttaactaaatttaccaccagatacaaacantacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaatagcttaactg

SEQ ID NO: 89154 - DNA, 5215 bp, Homo sapiens
  misc_feature (320)..(320): n is a, c, g, or t
  misc_feature (374)..(374): n is a, c, g, or t
  misc_feature (4612)..(4612): n is a, c, g, or t
  misc_feature (4716)..(4716): n is a, c, g, or t
ggcacgaggccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagacccgtaggagcaggaaatccacctgactgtgattccccactggcctctgccttgcctaggtcatccttcagcagctcctcagagctgtccagcagccacggcccggggttttcaaggcttaatcgaagagatggagctggtggctggacnccacttgtgtcaaataaataccaatggctgcaaattgaccttggagagagaatngaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttactggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggtaatcccacaaatgcagaagtcaaactaactaatattattattttaagaacaaataatctaatgaaaaaatttgataataaatattaatagaagagcaacccattcagtgctgctcttccataagtcaagaagaagccaaatatggccaggatctgggagagaggaggtggttgtttattctgtattgctttgttttgtttgtttagcaatgcaattctgtcaaaggtattattaatattttactatttaaaatatcaaaatatctttatttgttttactttactcaataggggaatgttctctagtttatcatagtgactgctggtggaatctattcattgatattgcagtgggaacttgtcttattctgattataaaagaacaaatactttagcaacttaaaaacacggtttaaaagcacacaacatagttattaaaatgggaataagtaagaaaatagacctgagtcaccacagaggaagtaaattacacattgtcatcggcattggaaggaaaatatactgtatagagaacaacaatgcttggttttatgtttcagattttctccacagaatgagtacatatttaagtttaaaacaaccaattccatctttttcatggattctgccaattatagatccttccattatgaagaagagtaaagccagcaagtgggtacatcgtggatagagtggtagctgatggcatcataggaattgcttataaaatagcttctctttctaaatgattaattatttgaaggtggcttcttgagcttttgtaatggtacttaaaagtgatttattttcatctttcctttcctcatcttcctttgcttccttatcattaaaattgtactttctgttgatgtttgcttctcatgggacatctaataggttaaccagagcacaaagaaacaagtcatcttgtcctcagggacagaattcaacgccgtcaaatctctcatattgggaaaggttttaggtaagtaggagaaagagctttttcccaaataagtgtcatgtcacaaactctggaagcattcatcatgctgaaagaagctccttgtcttacttgaataataatttcacagtgagtgacaatcaaggtgcaaactgtactcttgcctgagtgtacatataatcatgantaagtgctacctgtgagatgtgcaagggcgttcctggaaaaatacctccacacttaacctctcacttggcaatcatgcataatgaatcacggtatttttctaanccttcttgaaaagtgaaatgttgtcaaagctgacacgaagttcacagattatgtatgtattaatcaacatcaactccggagaccatcattcaatgataaaactacgtttgagttgaacacaagagaaaaaactggtaatcttattacagcagatgaatacagttttatttttctctcaagccctgctttgcctgttgtttccatcctttttgactttagtatctaacaggaatggggaggcatattcataaatatctgttacgcaaggtagaaagttacagtaattgtctatcatattgtctatcataatctgttgtaaaagcacagttagctttacatttaataaaggaactgaggaaagtaatctttttttaaaaaaacccatcttatgtaactcaattaagaaaatgaactatactttaatattaggatcaaaaagttgaataatatttattatatacatctttgtttccttccaaataaaggagacatggaattg

SEQ ID NO: 89155 - DNA, 5843 bp, Homo sapiens
  misc_feature (320)..(320): n is a, c, g, or t
  misc_feature (374)..(374): n is a, c, g, or t
  misc_feature (5593)..(5593): n is a, c, g, or t
  misc_feature (5627)..(5627): n is a, c, g, or t
ggcacgaggccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagacccgtaggagcaggaaatccacctgactgtgattccccactggcctctgccttgcctaggtcatccttcagcagctcctcagagctgtccagcagccacggcccggggttttcaaggcttaatcgaagagatggagctggtggctggacnccacttgtgtcaaataaataccaatggctgcaaattgaccttggagagagaatngaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttactggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggtaatcccacaaatgcagaagtcaaactaactaatattattattttaagaacaaataatctaatgaaaaaatttgataataaatattaatagaagagcaacccattcagtgctgctcttccataagtcaagaagaagccaaatatggccaggatctgggagagaggaggtggttgtttattctgtattgctttgttttgtttgtttagcaatgcaattctgtcaaaggtattattaatattttactatttaaaatatcaaaatatctttatttgttttactttactcaataggggaatgttctctagtttatcatagtgactgctggtggaatctattcattgatattgcagtgggaacttgtcttattctgattataaaagaacaaatactttagcaacttaaaaacacggtttaaaagcacacaacatagttattaaaatgggaataagtaagaaaatagacctgagtcaccacagaggaagtaaattacacattgtcatcggcattggaaggaaaatatactgtatagagaacaacaatgcttggttttatgtttcagattttctccacagaatgagtacatatttaagtttaaaacaaccaattccatctttttcatggattctgccaattatagatccttccattatgaagaagagtaaagccagcaagtgggtacatcgtggatagagtggtagctgatggcatcataggaattgcttataaaatagcttctctttctaaatgattaattatttgaaggtggcttcttgagcttttgtaatggtacttaaaagtgatttattttcatctttcctttcctcatcttcctttgcttccttatcattaaaattgtactttctgttgatgtttgcttctcatgggacatctaataggttaaccagagcacaaagaaacaagtcatcttgtcctcagggacagaattcaacgccgtcaaatctctcatattgggaaaggttttaggtcgttctggaccagcggatgagggagagcccttggttaatgcagacagaagagactctgctgtcatcggaggtaacaaggccctgaatgacctggtgcttgtcattatcgctttagataatgataccattacttagcacaatgggaaatatatgtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcacacaagcaggtgcagtgctgtcacctggctgaagacctgcagcctcggagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatggctataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattangtttttaactaaatttaccaccagatacaaacantacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaatagcttaactg

SEQ ID NO: 89156 - DNA, 95 bp, Homo sapiens
gatcacagatttcatcaggattgagctgcgtggtaagctcgccactctggacaagtcacagggtacccattatttagcaataaaagctttaactc

SEQ ID NO: 89157 - DNA, 358 bp, Homo sapiens
gttttatgtatgtaattggttttgctagccacatgtcaagttattgtgtcacttgggacaaagaaaaaaagaaatgtgttgaaaattcagctgtctcagaaacctaataatcagctgcatgctaatggatatatttatctaaagtttgtcaatataattagagaaccttgatggcagacccagtaatcacgtcatgtggggttatcttgcatatgctgctctttcacattaacctgtttttggttaacctgtttttggtaagacacttattttttgatgattgaaaaagggaaacagcagttgtatctgttttcttttaggtgcttgcccagctactgtgagcatgggggcgagtgtt

SEQ ID NO: 89158 - DNA, 5161 bp, Homo sapiens
  misc_feature (320)..(320): n is a, c, g, or t
  misc_feature (374)..(374): n is a, c, g, or t
  misc_feature (4612)..(4612): n is a, c, g, or t
  misc_feature (4716)..(4716): n is a, c, g, or t
ggcacgaggccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagacccgtaggagcaggaaatccacctgactgtgattccccactggcctctgccttgcctaggtcatccttcagcagctcctcagagctgtccagcagccacggcccggggttttcaaggcttaatcgaagagatggagctggtggctggacnccacttgtgtcaaataaataccaatggctgcaaattgaccttggagagagaatngaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttactggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggtaatcccacaaatgcagaagtcaaactaactaatattattattttaagaacaaataatctaatgaaaaaatttgataataaatattaatagaagagcaacccattcagtgctgctcttccataagtcaagaagaagccaaatatggccaggatctgggagagaggaggtggttgtttattctgtattgctttgttttgtttgtttagcaatgcaattctgtcaaaggtattattaatattttactatttaaaatatcaaaatatctttatttgttttactttactcaataggggaatgttctctagtttatcatagtgactgctggtggaatctattcattgatattgcagtgggaacttgtcttattctgattataaaagaacaaatactttagcaacttaaaaacacggtttaaaagcacacaacatagttattaaaatgggaataagtaagaaaatagacctgagtcaccacagaggaagtaaattacacattgtcatcggcattggaaggaaaatatactgtatagagaacaacaatgcttggttttatgtttcagattttctccacagaatgagtacatatttaagtttaaaacaaccaattccatctttttcatggattctgccaattatagatccttccattatgaagaagagtaaagccagcaagtgggtacatcgtggatagagtggtagctgatggcatcataggaattgcttataaaatagcttctctttctaaatgattaattatttgaaggtggcttcttgagcttttgtaatggtacttaaaagtgatttattttcatctttcctttcctcatcttcctttgcttccttatcattaaaattgtactttctgttgatgtttgcttctcatgggacatctaataggttaaccagagcacaaagaaacaagtcatcttgtcctcagggacagaattcaacgccgtcaaatctctcatattgggaaaggttttaggtaagtaggagaaagagctttttcccaaataagtgtcatgtcacaaactctggaagcattcatcatgctgaaagaagctccttgtcttacttgaataataatttcacagtgagtgacaatcaaggtgcaaactgtactcttgcctgagtgtacatataatcatgantaagtgctacctgtgagatgtgcaagggcgttcctggaaaaatacctccacacttaacctctcacttggcaatcatgcataatgaatcacggtatttttctaanccttcttgaaaagtgaaatgttgtcaaagctgacacgaagttcacagattatgtatgtattaatcaacatcaactccggagaccatcattcaatgataaaactacgtttgatatttttctctcaagccctgctttgcctgttgtttccatcctttttgactttagtatctaacaggaatggggaggcatattcataaatatctgttacgcaaggtagaaagttacagtaattgtctatcatattgtctatcataatctgttgtaaaagcacagttagctttacatttaataaaggaactgaggaaagtaatctttttttaaaaaaacccatcttatgtaactcaattaagaaaatgaactatactttaatattaggatcaaaaagttgaataatatttattatatacatctttgtttccttccaaataaaggagacatggaattg

SEQ ID NO: 89159 - DNA, 2519 bp, Homo sapiens
  misc_feature (320)..(320): n is a, c, g, or t
  misc_feature (374)..(374): n is a, c, g, or t
ggcacgaggccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagacccgtaggagcaggaaatccacctgactgtgattccccactggcctctgccttgcctaggtcatccttcagcagctcctcagagctgtccagcagccacggcccggggttttcaaggcttaatcgaagagatggagctggtggctggacnccacttgtgtcaaataaataccaatggctgcaaattgaccttggagagagaatngaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttactggggaggttctctgcctgatgctcaaaagtgtacttgtggattagaggggaactgcattgattctcagtattactgcaactgtgatgctggccggaatgaatggtgatttccacatgatttccctgcacaaaaatgtggtttttattctttaattatgcatagttaattaaatgtcagacaagctggtacaataaggtaactaaagtatgttcaagcaagctgaaatacaagttttgatgaaatatgatcagttaatctaaggattaaattttatgacc

SEQ ID NO: 89160 - DNA, 407 bp, Homo sapiens
gagagacagagagagagaactagaaatcagacaggaaaagaaagggaattcatccactggaaatatctgtgatcccacaaaagaaacaaatgaaaacatggttaacctcaggggaatgcaaattaaaacaagaagctatgtttcacccataacactggcatcattttgtaaagatgatataataaagataataataggtggagctggcagaatgtggaggaacagagctctttctgacgttgctgatgtgaatgggagtggtggcagcttttctgtgagtgccttcacagggggctgccccttgattcagcaattccacatgtaggacttgctcatttattctagttttgttgttgttgttgttgtttgtttgtttgttgttttgagacaaggtcttgccgtattgc

SEQ ID NO: 89161 - DNA, 747 bp, Homo sapiens
gggcggaggtctcgccattgcactccagcctggacaacaagagcgaaactccgcctcaaaaaaaaaaaaaaaaaagacattggtctcattgctttttcttcaacttctgctactgtggaggataattctctcccaagactgccccccttcccactttaaatcagactcccatttccacctgatgcactataagtatttccatggatagccactggaatctttcttcaaaagaattccgcaggttttacagtgttttgttgcattttttcttccaatttactataggcaagagcggacgttcggagattcgttttaaggtctaacagtcttagtcaaaacttgttacttgactctgatgatagctgtgcaaaacaaaagctaaaaaaaatggcttacaatctaaatattgcccgagggcatattttcttggtctggacagtatttttttgcaaattgaactgtcatttaaggatgagatttttattttctggctcttgttagcatttgagtttgcctctccaatataaaacttagtttctaactattcctaccttgtgcttgtcattatttgttgaggataatatgatgaaagcagcttaactgttttgtatcctcagcctttgttaatctacagaagaaagattgttgaaacagaccaaggttttggcactggaggtatgttaggtttcctggggagtaagtgtttccctagttgattctaatgtgtatccgggttcagaactacaa

SEQ ID NO: 89162 - DNA, 175 bp, Homo sapiens
atgattctcgcctaaaataattattacagtgacagttgccataaaataatttctacattttatcattctttccatttcttacttggccttctgctgttgggcagagctttcttttcttccttattaatttatgtactcaaatcagtacagactcatgcattccctttttatttaa

SEQ ID NO: 89163 - DNA, 233 bp, Homo sapiens
agactgccttattggtatcttatttaaatgagaaccattttcccaatgctttctgatgtgtgggagatttaccttgacaaacttacagtcatatgggcaaagtttgaaaggcatagcattcaggaattgtgtacttaaattctctcaagatccctttaattcaaagagaattaaagaccaattttggcatttgtaatttgaaagggtcaaatttttcttctgtcattttcaaa

SEQ ID NO: 89164 - DNA, 359 bp, Homo sapiens
caggatcaatactttgtatccttcaatccaatcaagttgacactattaaccatcacaggacctgtccccgtctccactgcaggaagttaggacccatccctgtctccacccaggaagttaggacctgtctctgtttctatcacaggaagttgggatctggccctgtggacccagatgggttactgagcttggaacacgagggcttagtgacaaggaactgggaactgacctcaatggctgagtagcgatatggctccctcactcactctgtgaccttgggaagtgggaggccacattctctctgagcctcagtgtcctcatgtgaaaaatatcaccgaagccactgtcatggggtggtg

SEQ ID NO: 89165 - DNA, 332 bp, Homo sapiens
ttatatggctcctaagtccatgttctatcctgtgatgccccctccattatagaacaacacagaaaaacaaattcatagcactaagtacaccagattttctatagcctaaactagtctcataagtctttttttctattaatcagacctttgtagaggagacagtgatgtttaacatacacacacacacacatacaggccagaaagttggctaataagttgttaccctttttgccggcataccaggtttccaggttccctttctctgcagcttccagaagaacggagcggcctttgataactgttcactatgctatagctgtgggggccaagcc

SEQ ID NO: 89166 - DNA, 364 bp, Homo sapiens
accaagctaatttttgtaactttagtaaagacagggttttaccatgttggccaggatggtcttgatctcttgaccctgtgatctgcccgtctaggcctcccaaagtgctgggattacaggggtgaaccactgcgcctggctctcttcccataaatattctatagttcaatctctcttttattcaaatctgtgtccccaaaatcacttccagagatgacttaaaccactgtgtgtcctgaccactgtgacttaaacatcacacccaggatttctccagttctctctgctttatttctccttataattctaatcctttattgacattattttagagattttagagatatatgtatttgtttgcatg

SEQ ID NO: 89167 - DNA, 396 bp, Homo sapiens
gtcctcttcccacaccctgaagcttggttatcacgacagagtcccatggccggtcgctcagggcaaccgacacacaccccaggaagggacaggaagggacactggctgaaatcagacactttacgtacgcgtcttggatcctcaggctgacagggctttctccaggggaaacaactggagagagattaaataacatttcctaaggtcaggccaactggtaacagcaagaagcaaagtaagacttgcatccatgtctttctggcttcaaagcctgcaccctctcccctctaggtgccaccggagctgcccgagaggactgaacctttccactcagctgccagttgctagctggcctgtgctctgaggatattttccgaatcagcttgtcagctcatg

SEQ ID NO: 89168 - DNA, 159 bp, Homo sapiens
aattgaaggaaataacctcaatataataaaaactatgaaaagcccatagctaacctcacactcgatgacacactgaaagcttttcctctaagatcaggaagaagacaaagctgcatgcttttactgcttctattcaacacagtacttaagttccagcca

SEQ ID NO: 89169 - DNA, 737 bp, Homo sapiens
tagccctccagacgtttctgtctaaaaactacagtatttttctactaactccaaaaggcctgaaggtatttttattaccatgagagtttcagctgtgaccagagttcatttgcgcaatctttacattccagtgcactaagtgctttctcacgcagggacaaaagaagtctttgtcccatgcttgtgaaaagcaccatctttgctagatgagttaactgctaaacttagggctgctgcaatgacatgctgggaaaccacatgaatctaggcacatccaaatagtgaaataggatgggttttaggaaagcaaaccacatggatgtgtatgtgcatgtgtgtgtgcatgtgcttgtacgtgtgtgtgttttaaggtaacatattttgagtaccatctatatgccaggcatcgtgctaaatgcttcatactttacaacaatcccgtgaggtgggaactttgattagcacccctttataggcaaggaaactcagtcttagcaaagttccgtgttttccccaagtcgggtggctaatgagtgagttgtggagccagcatttgaacctgggctcacatacgctctcatccactatgctccactgactggaactggctgtagtgaaataagccctgcagattttagtttaattttctgagtagtaacttttggcaagaatggtcatttaaatgcaccaaaaaaaaaaaaaaaagaaaaaagattgggctgggtgcgacggctcat

SEQ ID NO: 89170 - DNA, 631 bp, Homo sapiens
ttggcaatagtactaacatagggttttatcttgggatacatatgtattggtctgtttgttgaccttgacatctgatcactgatgtcaatgacctactggcctcattcaggacacctgcagagagtatgcaaagtccgagagaggaaaacagaaatctgtatgtgagatggtcattgtacagaaagaagtggcccctctgcaacatgtcctcacagaaacgaaatggtgtgtagcaatcaacactagaaagtagaccttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttca

SEQ ID NO: 89171 - DNA, 838 bp, Homo sapiens
  misc_feature (695)..(696): n is a, c, g, or t
ttggcaatagtactaacatagggttttatcttgggatacatatgtattggtctgtttgttgaccttgacatctgatcactgatgtcaatgacctactggcctcattcaggacacctgcagagagtatgcaaagtccgagagaggaaaacagaaatctgtatgtgagatggtcattgtacagaaagaagtggcccctctgcaacatgtcctcacagaaacgaaatggtgtgtagcaatcaacactagaaagtagaccttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttcaaaaaaaaaaaaaatggcctcttagactaaaatggccaccaggccctttttttttttttttaatnntttttttttttttttttttttttccgaataaacaatttttaattcactttttccatttctttataaagagcttttactagcgctttctccctaaaataggaaagggggtgaagaagttgccccctcaaggaaaaaaggtaac

SEQ ID NO: 89172 - DNA, 5302 bp, Homo sapiens
  misc_feature (34)..(34): n is a, c, g, or t
  misc_feature (142)..(142): n is a, c, g, or t
  misc_feature (358)..(358): n is a, c, g, or t
tgccccgcgcgctctgctacgggcccgctgggcntccgcgccttctagcttccggagcccactttgatcggggccataatacctattgagatcccctcttctgtcttgtaccttcgccactggcatcggatttgcagaagcntgcgtgggatcagaggaccgccctccccacaacaaccggcccctgcatcttagcagccgttggaagccccagctcttttaccgccaagttcatccttgggagacagaagacgcgtgatctcctctccgctgctcttggggtctccttgcagccctggccaggcggattcatcctcaggacctaaagttgcccaaggagctcctgctctgccagagnagggtggagagggcggtgggaggcgtgtgcctgagtgggctctactgccttgttccatattattttgtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccatgtgggactaatgaatgcttcatagtggaaatatttgaaatatattgtaaaatacagaacagacttatttttattatgagaataaagactttttttctgcatttg

SEQ ID NO: 89173 - DNA, 1020 bp, Homo sapiens
cggacgcgctgggtcgacccacgcgtccggcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccatgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttgtaacatgctgaagacaagcagaagcacatgcacgagggacagaggagctactgtgcactgctgtgaaattgcccagagcataaaacctgtgtaccctccttcacatcaaccaagttcactaggacataccaagcacatgcgtgtgaatgaggatgcaaggcaagagaatggaactccagaattcacagaatagaacaaatggatgagaaatatttcatgcaaaatataaagtgtcctgaggatctgggttccatttacgagaggaaatgaaagtgctaaaataaattttatcttccttttaaatgtcagcatgtcagcagaagcagcacacaaaagtctttaccattttccagtattaatttttttgtaatataaatgataaaggagatgataaagaaccaatagattattgataaataaattagtaataatatga

SEQ ID NO: 89174 - DNA, 435 bp, Homo sapiens
gttcttaaaatgcttgtgctttttgttcttttctagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccatgtgggactaatgaatgcttcatagtggaaatatttgaaatatattgtaaaatacagaacagacttatttttattatgagaataaagactttttttctgcatttgg

SEQ ID NO: 89175 - DNA, 5278 bp, Homo sapiens
  misc_feature (34)..(34): n is a, c, g, or t
  misc_feature (142)..(142): n is a, c, g, or t
  misc_feature (358)..(358): n is a, c, g, or t
tgccccgcgcgctctgctacgggcccgctgggcntccgcgccttctagcttccggagcccactttgatcggggccataatacctattgagatcccctcttctgtcttgtaccttcgccactggcatcggatttgcagaagcntgcgtgggatcagaggaccgccctccccacaacaaccggcccctgcatcttagcagccgttggaagccccagctcttttaccgccaagttcatccttgggagacagaagacgcgtgatctcctctccgctgctcttggggtctccttgcagccctggccaggcggattcatcctcaggacctaaagttgcccaaggagctcctgctctgccagagnagggtggagagggcggtgggaggcgtgtgcctgagtgggctctactgccttgttccatattattttgtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccatgtgggactaatgaatgcttcatagtggaaatatttgaaatatattgtaaaatacagaacagacttatttttattatgagaataaagactttttttctgcatttg

SEQ ID NO: 89176 - DNA, 5835 bp, Homo sapiens
  misc_feature (34)..(34): n is a, c, g, or t
  misc_feature (142)..(142): n is a, c, g, or t
  misc_feature (358)..(358): n is a, c, g, or t
tgccccgcgcgctctgctacgggcccgctgggcntccgcgccttctagcttccggagcccactttgatcggggccataatacctattgagatcccctcttctgtcttgtaccttcgccactggcatcggatttgcagaagcntgcgtgggatcagaggaccgccctccccacaacaaccggcccctgcatcttagcagccgttggaagccccagctcttttaccgccaagttcatccttgggagacagaagacgcgtgatctcctctccgctgctcttggggtctccttgcagccctggccaggcggattcatcctcaggacctaaagttgcccaaggagctcctgctctgccagagnagggtggagagggcggtgggaggcgtgtgcctgagtgggctctactgccttgttccatattattttgtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccatgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttgtaacatgctgaagacaagcagaagcacatgcacgagggacagaggagctactgtgcactgctgtgaaattgcccagagcataaaacctgtgtaccctccttcacatcaaccaagttcactaggacataccaagcacatgcgtgtgaatgaggatgcaaggcaagagaatggaactccagaattcacagaatagaacaaatggatgagaaatatttcatgcaaaatataaagtgtcctgaggatctgggttccatttacgagaggaaatgaaagtgctaaaataaattttatcttccttttaaatgtcagcatgtcagcagaagcagcacacaaaagtctttaccattttccagtattaatttttttgtaatataaatgataaaggagatgataaagaaccaatagattattgataaataaattagtaataatatga

SEQ ID NO: 89177 - DNA, 262 bp, Homo sapiens
caacactatctcttgttagataaggacagtatttatggtcaaacatttttcataccagattatattaatacatgctgatctctcgacttgctggtctcttagagaagctccgtctgtactatttagaagttaggatttcaaataagaatgtgcattgcagtctttctatgagggtctgtgaaactttggtgatatttgctactgacgtctgtttctttctctctactgtcttcaatgttagcttcttgaggaaagaacctta

SEQ ID NO: 89178 - DNA, 344 bp, Homo sapiens
acatgaatactacctccatgtcagcatagggtttacattttaaatggctgcatagaattctcttacatgttaacgaaaaggaaaactgagagatggcttggctatatttttattttaaattgcatttttttctttctcagacctcttagggatgaattgccatattctctatcctttttcctctcagataaagttgtaagtaaaatcttgctgtaaatgtagacgagataaatctgttcttctttccactcttcctcattgtcactctagcctccaaattctgcagtcacttctggttgttaggtaattcatacaatgctgccattattttttattttttattt

SEQ ID NO: 89179 - DNA, 219 bp, Homo sapiens
aagcggagaagataacacctgcaaaagtatgccacagttatgttgggaatttcaatatgatggagctctgagtgtacatgtatgtgaggaaaaggaggtaaacaaggagttagaaagatgtgatgagaccaggtggtgatggactgaatataaagcaaagacatctggatttttaattctgtagggaatagctgaccaaggtatatgattacatgtctg

SEQ ID NO: 89180 - DNA, 369 bp, Homo sapiens
  misc_feature (242)..(242): n is a, c, g, or t
  misc_feature (347)..(347): n is a, c, g, or t
  misc_feature (358)..(358): n is a, c, g, or t
tttatttcacttgaatccctagggacttacatttccacattaataagaatacactgattcttacacacaagggtaaatatagtaactgagactcatgctgaaggtcatgtttggaatctcatatttcctttgcatcttagtttcatacattctttctggattctttctagcatttccaaatcctattcatcctcaggctggtcttgaactcccgacctcaggtgatccactggcctcggctncccaaagtgctgggattacaggtgtgagccactgtttctcttctttaatgaaagtgtttcccagttctaatttctgtgttcttagtgactggctgtcttgcaatngatacaagtcntttttgaaaag

SEQ ID NO: 89181 - DNA, 690 bp, Homo sapiens
aaaggaacccatacatctatagtcagttgattttccacaaaggtgccacaaacacccaatgagaaaaggacaagtctcttcagtaaagggtgttgggaaaagtggatatctacatgcagaagaataaagttagacccttatctcacgccacatgcaaaaatcaattcagaatggattaaagacttttaaacatacctactgaatttgaaaaactactgtaaggaaacatagggggagagcttcttgttattggtctgggggatgattttttgaatttgaccccaaaacaggcaacaaaagcaaaaacagacaaatgggattacatcaaactgaaaacttttgcatgacaaaggaaacaagcaacagagtaaagagacaaactacagattgggagaaaatatttgcaagccatacatctaataagaggttactatccagtctgtataagaaacttaagcacctgaatatcaagagaacagataactgaatttaaaaaagcatgaaggacttgaataaacattttcaaaagaagatatacagatggttaacaggcatatgaaaaaatgctcatcactgatcaccagggaaatataaattaaaaccgcaatgaggtgtcacctcacacctatcagaatggctgttatcaaaaagatgaaagatacgtgttggtgaagatgtggagcagaggga

SEQ ID NO: 89182 - DNA, 430 bp, Homo sapiens
ctttttgttagaaaacctaaaacactgcaatcagcacactggagcacaaactataccaattataatactatcaaagctaaatattaacttaggtttacagtggtgtcttaaaagtggactcaaatttaattaatgcactacattcccaactaggaaaaaaataacctcaaccttttcttaaaaccgcaaaatttttcctctgaattgttgttttcaaagaatctaggaactaaacaactataagcagactacattatcttaaaacctacatttgactaaacaccaaaaacagaagaaaaaaagctattatttcatgttatcaacttcagtggtaacttaaaaatatttagagtttcaatgaattgaccttgtcaaatagtaaaaggcctagagccttacatgtcattataaaatttccttaaaaggctgg

SEQ ID NO: 89183 - DNA, 328 bp, Homo sapiens
gtctaaagacacacataaccaaagcatatgatgaggtgtaatattcaggtgctatgccagacacctgaggcctcagcaacatttccagaactgagagttttctgcttctgggtccctgaaagcccctttgcaggctgtgtgaagaaataccaagtttcctcatgttcctctgccaaatgtttcactggatgaagatgtggtcatacagcagagaaaaggcaagcctacatagcaatctttgggctcaattacctggaaggcttaagaagtgagatattctggtttactaaatctctttatggattcagtattaaccagaaatttcttt

SEQ ID NO: 89184 - DNA, 616 bp, Homo sapiens
tgaaagtactaaaatcttttatatgcattgcattataacgtcattgcattgaatactgctggcaataagctagaagttagaaaaactttgctttatggtaaaattaagtacaatgagatttgattccttacattcaagccccactgatttgtctcttgaaatttagatgaggagaaaacacaaattaatttatattttcagctaacaagatggctacatgacagctatggccacaagaaaaatttagacagactaatgtttgagtaaccatggcttcaaagccccttgccagtattctaaattactttttcttcttctccaaattacttgtgatttctcagattttttatttaattattgagtgtacagtacatatgctctttttgtaaggaatctcaactccttgtattagaaatgggaaataacagatgaatctaaatgtcttgtttcttccatgagactgcgccttctttcctttccaattcatgtgctcaacacagcaccaaccaatgactcagaacctcctaaactctgtacaccacatggtcaagcattttctttccaggtagccaagtctgcagtgccccttcctccataaagcctccagaaataatga

SEQ ID NO: 89185 - DNA, 510 bp, Homo sapiens
taagtgggagctaaataatgagaacacatggacacgtagagtggaacaacacacactggggtctattggagggtggagggtaggaggagggagaggatcaggacaaaaaagcagtgggtactaggcttaataactggctgatgaagtaatctgtacaacaaccccccatgacacaagtttacctatgttaacaaacctgcacatgtaaccctgaacttaaaactaaagttttttttaaaaaaaagaaaaacaatttggtgtccaagatggtgtaaataaaaaaagatacctcagtatttaaaaacaaacaaacaaacaaagtttaaacttttttgactaatataataattgctgctcagagcaatgaactcaatgctataaaaatgcatctgaagcttataaacatcactcctgtacagatagaattttctttctttcttttttttttttttttttcttgagaggaagtcttgctctgttgctcaggctggagtgcagtggtgtgatctt

SEQ ID NO: 89186 - DNA, 233 bp, Homo sapiens
gaaggttatggcaggtataaaaaccccataaaaccaaagcaaaacctccagtgaggaattgtcttttataccaactcccaaaacaaaggccaaattccaaaacgaagtctgtttgcttcttactttcctaatataaagggaatgggtgattttttcccccaaatgcagtttcatgttggtgaaatcagaatacaacagtagggtctctagcggcagaattgggcgtacgggga

SEQ ID NO: 89187 - DNA, 983 bp, Homo sapiens
tgggggacctcccttgggagatcaatcccctgtcctcctgctctttgctctgtgagaacgatccacctatgacctcaggtcctcagactgaccagcccaagaaacatctcacgaatttcaaatctgatctgctcagcttagcgactgaagattaatgctgcctgatcacctcagaagccccctggaccatcacagatgcccaacttcaggtgactctcaagtggaggatccccagccacatgaagacaccctagctggacgatcagttcttgttaagaatctgaaccctcaaactctacaacctcgatggaccagaccctacttagtcatctgtagtaccctgactgctgtctgcctgcaggatcttccacactgggttcaccattccagaataaagctgtgtccatcaggcagccagcctaatccctctcttcctcctggaagtcacaagtactctcccctacttcccttaaactcactcatatttctgaagaacagtaataacccttatgagcctaatacatccctttattctattaggtctctccatccttaccctactttttgcagcacagctttatgaaatcacccccaccaattgggctgagccccaaaaagaaactattcatccctactgtcttctatctagtcatactccattctcaactacctataaatgccctactcttatttacactgatggtttacactgtttcttcaagccatcacagctgatatctcttcgtgctatccccacaccaccactcttaagtctctcttagagtggatagatgatctttactggcagggcatcctcctatacttccatcctgatgaagttctattctttacttttatactcactcttattctcgttcccaatcttatgccaccctctacctctccccagctatctccaccacactatcaaccttacacattctctcctagccacttctaatccctccttagtgaacaactgc

SEQ ID NO: 89188 - DNA, 386 bp, Homo sapiens
tgggggacctcccttgggagatcaatcccctgtcctcctgctctttgctctgtgagaacgatccacctatgacctcaggtcctcagactgaccagcccaagaaacatctcacgaatttcaaatctgatctgctcagcttagcgactgaagattaatgctgcctgatcacctcagaagccccctggaccatcacagatgcccaacttcaggtgactctcaagtggagggcctctgagcccaagccgagccatcgcatcccctgtgatttgaaggtatatgcccaggtggcctgaagtaaccgaagaatcgcaaaagaagtgaaaatgcgctgccccgccttaactgatgacattccaccacaaaataagtgcaaatgccagtccttg

SEQ ID NO: 89189 - DNA, 458 bp, Homo sapiens
tgggggacctcccttgggagatcaatcccctgtcctcctgctctttgctctgtgagaacgatccacctatgacctcaggtcctcagactgaccagcccaagaaacatctcacgaatttcaaatctgatctgctcagcttagcgactgaagattaatgctgcctgatcacctcagaagccccctggaccatcacagatgcccaacttcaggtgactctcaagtggaggatcctataagatggccccacgcttatctccctttgctgactctcttttcggacttggcccacttgcaccaaggcctctgagcccaagccgagccatcgcatcccctgtgatttgaaggtatatgcccaggtggcctgaagtaaccgaagaatcgcaaaagaagtgaaaatgcgctgccccgccttaactgatgacattccaccacaaaataagtgcaaatgccagtccttg

SEQ ID NO: 89190 - DNA, 183 bp, Homo sapiens
tgctgcatggatgctgctgctttaaaccttggatgaacttcactgacaccattcttccctagacattcaccaaaaaatgtgtatattttgttcatatacatttccatgttataattatggaagatgtgtaatccacttgcatgttaattaaaggaaacaaacaactgaagttttgaagggtca

SEQ ID NO: 89191 - DNA, 567 bp, Homo sapiens
gggacggctggctggctgcagaagatgggtccttctagcagctcccagtgaatatgactaatcagttcaacatcacagaaagagcccaggcctgagagggagaagattaacagcgaggtgactgtgagcaagttactgccctctaggctggagctgcctcactggcatatctgagaggcagtgttgggtagtgattaagagcaaaatctacaaccagtattgctagattggactcctggctttaccactaacaagagcagggctctcagcctctataagccaaatgccctcatttgtaaaatttccttatttcaaatcctgtcggtgcaagattaagagttaatatatacaaataaagtacttggaacagtagatggcacagaaaacattatgtgtgtttactagtattacggccactagtattaatgcctttactgccatatcgaggatgttggattagtgagcctttgaaggtctcttaaaaagtctgcagttctatttccctgcactatgagccccgtttagatttcagacttaatctagcatttgctgagtgcttactatata

SEQ ID NO: 89192 - DNA, 284 bp, Homo sapiens
cttttctctggaatctcttgtcaggttactctttgtttccttaggcttgttgtgcataagagacttctataataattcctctgttcatttttctagaaacaccaagcaaatgttcaaggagatcaaattaagttcactataagatcataaggaggccactagcagaatcagcagaattaggctcttataaattattattagttttacttcatgacccaaactcaataacagtcaagaattcactattttcctcttggttgtatagctgttctcataactcatat

SEQ ID NO: 89193 - DNA, 192 bp, Homo sapiens
ccaacatatataaggagttcaacttcaactacctgagccgtatagacatagagagagatgctctaggaatatcagattatttgttactcttgtgcgaaaggcataataatggctccccaaagctgtccatgacctgattcctagagccggtgaatatgttacattacatggcaaagggaaattagggttgga

SEQ ID NO: 89194 - DNA, 448 bp, Homo sapiens
aacaatttagtagattatacttttgtaaacagaaattaagcgtttatctttttttcttgcctgatttttccagaattttgaaatccttactgaatactcttatttccacgatgatatagttgttagcaaaagtccaataagaatctattcaccttataacaggacataattggaaattttggttatattatcaaggtttttactggaatatcatatttaggaagtgtacctaagatcagttatgaccagcaattttaaggaagtaaggttgacttttatggagacaatgcttacaaagcactgtggaaaactttgaggaaagttcttcctcaaagattataaagtcacaactacccactatttttatatgtgtgtgtgtgtgtgtgtgtgtgtgtgtgtgtgtgtgtgttccaaatcacttgtcctagcttgctccagcatgcctgga

SEQ ID NO: 89195 - DNA, 574 bp, Homo sapiens
taacttcctcatcaacctatgggctccctgaggtcagaaaactccatgttatttgtctttgtatccccagtgcctagtgtggaaactgacacataacaagtgtttaatacgtgttctttgaatcagtggatggaagaaaattgagtctctccaaagtggtagatgagtttactactttaacactctggataggaatttaggaaatgctaatgtgatcagcatgcctatgtcaatggtcaacaaagggaacgacttgcactaaagagtcctggtagtatagttctcatataaacctatttcaaagaaacccacagacagacacatttatctgtgacggtagaagtcagagagaagagttagaaaaggcccccagggctgctgacagggcaaatacagtctcacatgcactacaaagacccgactctgacacctttctccagctttctcctgtgtgcattcagctcacatgaccagtgcagccaggccgcaccagagggaagatgaaggccattgtatctattgtcctttcatccacccctttttctaaattctatgggattaccctgaaaaggac

SEQ ID NO: 89196 - DNA, 507 bp, Homo sapiens
tagcatttccggcccccaagaatccctcttcctgtcctcttccagtaactgctcccttcctctctcaggggtaatcactatcccaacttgtaccatcacagattacttacaatttttttcttcttagatgtttttctactttttaattgaagtatgacttagtttactgcaaacatttcaagtgtgtactttggtagattaaaaaaaatagacttcatggccgggcacggtggctcacacctgtcatcccagtactttgggaggccgaggcaggcagatcacttgaggtcaggagttagagactagcctggccaacatagtgaaacctcgtctctactaaaaaatacaaaaattagctgggcgtggtggcgagcgtctgtagtcccagctacccgggaggctgaggcaggagaatcacttgaacctgggaggtggaggctgcagtgagccaagattgcgccactgcacttccagcctgggcgacagagtgacactgtctcaaaaaaa

SEQ ID NO: 89197 - DNA, 334 bp, Homo sapiens
taaataattgtttattaataattgtaaatttatttgttggagtcagaatggcttacactgccttatcatctagcctctggactctctagtagtgcttttatctgacactggtggggcatggaatgttctacacatcgctggtttccagctaacaagcatattcctttttaagtttcagttttatggtttttttgtttgtttgtttttaagagatgggctcttactgtgttggtcagggtagtgttggactcttggcctcaagaaatcctcccaccttggcctcccaaagtgctgggattacaggcatgagctaccacacctggccaagtttttt

SEQ ID NO: 89198 - DNA, 230 bp, Homo sapiens
acagggtgggtggcgtggccaggcctcagtgatggtgctgtgcagggctggggcgagctgatgtacgtgactgttggctacagggaaacctgtctggattctgtaggttgttttatcaaggcagaccttcaaccactggtcttgcagcctctgctcccactcctctagtgacaggaaactcagtcctttcccaggcaaccctgaaaatgagaaccttcttcccctccaag

SEQ ID NO: 89199 - DNA, 389 bp, Homo sapiens
gccttccctgagatcccatgtgaaatatagtcagggattacttccctgggcttgcgctggagactgggagtacctacgaggctgttcctgctgttgcttctacttttacattttacgtggccccctaaatccattccacctctaggtaaggttaaatcctccaactgtgatctggattctcagattcactcagggggtatgtgttcgaaggcaggtcttcccccctcacactttgggaattcacagtttttcacctaactcacagagtttgcagtgatcctttcaaaagatctgtgaattcgtttggttttcctggtactttcctgtggtggtttttggaatgatagttcacattgtgaatctccacacactgttctgtccatccacgt

SEQ ID NO: 89200 - DNA, 496 bp, Homo sapiens
ctaagtagctggtactataggtgtgcaccatcatgcctggctaatttttttgattttttttaaaaaattgattctcttatatacacctttatttgtactaaaaattgtaaaaagagcacaaagtttcctcttattgcaacccaaatttttcttattattacgctgtagccaaactacccaatgctttctttacccacaagtgactttgcttcaaattctcggtgttgggtttcatctcactggctttgggcttctaaaacacatggggatgcttatgtcctcttggcttcgagtcaaattaagcagtagagctgaagtatactgaagttattcagatacgttcaaactacacagaccccttatacatcactagtatcatggtagaaaggaaaagatacaagaaaaatacatcctagaactcattatcaaaatttttgatatatagtctattgtagcataaggtagctttctcaacctgctacataaaattaccagc

SEQ ID NO: 89201 - DNA, 403 bp, Homo sapiens
atagaagcaagagtcctttgactccatctcatcatactctagcttcagcaaactcattaagattggggccaaaattctggtcgctgctagtactccgcagaaatagttggccctgtatttgctacccgagagcagatggagaaaaaattctcttttggccagcgaacttccttcttgcttgttgaagatcagtgtttcaatttcccacttatcccaatgaagttctgagaaggaagcacatctgcatccttttctctgttttgcatctgttttaagaaagaccaggccactagactgtgggaactatcttcttcctaatgggagtactgggagcttttcttaatacctgtgtacagctgggcatatccatgatacctgtttgtagccattctcctgtttcagt

SEQ ID NO: 89202 - DNA, 413 bp, Homo sapiens
ggagccagtggcattgtaaatgcatggccctttccttccctgtctgctataagcattagcagtctgcactgagatgaagagaggtgtagtgactagggaacaattgtcacgtgctttgtgcctattcccgtgcagggaggataaacccagggtccatgaatcaggaagtgtctccaaacatgcttttcaaagagcattagaggtttagatctagaagggcttggaggtcttccagtctgaggaagaaactgagacccagggggtgaagagtcttcaaggtaatgcagcaagtgtctaatgaggactgagctgggaccagaatcaggagtttttttcattgcaatatatattttcgttgatcctttttttttcttcccttctagcctcttttcctttacaaatagcagcataca

SEQ ID NO: 89203 - DNA, 442 bp, Homo sapiens
tggcccaggaccaatcaggggctgaagtgatgattcatagaggctcggctcacagtccaaagcatgtccagaaaaggaaagtggtcaccagagcctgttagtccaagctgcaccgatttgtaagcccccaccatttcacagactctggtcagagggaaacagtccactggggtttgggctgcgagaaacatcctccccaaccgcctgacttccttatcacatcctgctggggaaaggcccaagaaacatccttatcaacattctcccaggcaacaagctatactgcccagatccctcctgcccaggcctataattactccagcctgtaagcggcagtgggctctggcatttagttggtcccctccatagagccgccaactctctctctttctttaaccttcaccttcccttcaaaatctaacagagcccaccatatacatgc

SEQ ID NO: 89204 - DNA, 381 bp, Homo sapiens
tcaaaaaataatttttaaaaacactattatctgcacatacctttaaatctgctataaagactagtgttattacataacaatttacatagtacatttctctcagagttttacgttaggaaaacgtttgctttttccaaggaagagagatagttccttttaacagacaataagctgtgtaactcaggggttttcctattgcctccctgcctttctgcctacggatgagttgtgtgctcacctgaagtagctttcttcctttaaactgaagtttctgatacaatcatcacgttccacagccagctcccactccattacccatttaatctggctcttatctttttactcttgttttaatttttaccgtattacaattggtccttg

SEQ ID NO: 89205 - DNA, 480 bp, Homo sapiens
gtttgagacggagtcttgctctgtcacttaagctgaagtgcagtggtgagattatagctcactctagcctcaaactcctgggctcaagccatcctcccacttcagcctccgcagtagcttggactacaggcacgcaccaccatgcccagataattttttattatttttgtagagacagggtcttgctatgttgcctaggcttaaagtttttttaaaattaattccatgtcatctcaaagaatattagaggttttgctactgtcatcaaaatgcatgtcatgcagccagctcacacagaagttgtgtttattgtttctcaattcctggaatagattcttaaaacttctggtttttattacccaccttaatagttgaaatagaaatatctgtaggttagcaacctacttcaacaccaagcagataaagtttcttgatgggtaggacttctaagaacattttcattaactccagaccttttcg

SEQ ID NO: 89206 - DNA, 459 bp, Homo sapiens
cggctgccctagaggaccccaacgttggccccattctcagggatataactgctattccagtttaataactagcttcaaaacaaaatgaatttttatattttctagatgaataatgtacaaccaccatcttcgtctgagcttgttattactttcaaacacaaagcttcattttaagcttggttaaaaaaaaaaaaaaaaaaaaaacggggatggggccgacctttgtggcccatccaagtggaatgtatgtctggtccaatgggcctggtgatgtgatcaaccgggattttaagggatatgcaatctcaacaagaccacagggagggttatctcgatggtgcaccagtttcagtacctaggaggggcttctcatcgagaggtgcctggatccaaaaggtcatccttgaaactgatactccagggggaaaagtggcaggagaaatgcgagaaatgggccca

SEQ ID NO: 89207 - DNA, 924 bp, Homo sapiens
cctataaatgtttaatggcttctacatccattcttttttaaagctgcatcttaaaatagaccaatttaatcattgtgcatgtaacaagcagattaatgagttctgaagttagctttaaagttaaatagacttaagataacactgtttttaaaattttggccaattcatcaaacttgaatgacgtccagtaacattcactaacatttcacaaaaggtaccattttattgtcaatcacaaaaataaccacttaaaattgaaatcttaatttctagtaccttggcttagagttcaggccatattatgaaccaattcaaatagacaagaacaaaaaatatctaaaaatcaggttttttttttaaaaaaaactttattttaaaattttggttacagtttcattcttaacaagtctactactgtttaatctctcaggattaaaaaaacatttattaagattctaaagaattaaacaacaaaggaatgtcaagagaagggccccattctcagggatataactgctattccagtttaataactagcttcaaaacaaaatgaatttttatattttctagatgaataatgtacaaccaccatcttcgtctgagcttgttattactttcaaacacaaagcttcattttaagcttggttaaaaaaaaaaaaaaaaaaaaaacggggatggggccgacctttgtggcccatccaagtggaatgtatgtctggtccaatgggcctggtgatgtgatcaaccgggattttaagggatatgcaatctcaacaagaccacagggagggttatctcgatggtgcaccagtttcagtacctaggaggggcttctcatcgagaggtgcctggatccaaaaggtcatccttgaaactgatactccagggggaaaagtggcaggagaaatgcgagaaatgggccca

SEQ ID NO: 89208 - DNA, 1350 bp, Homo sapiens
ttcagccctagagtcattgtgaaaagatctatcttcagatataaggaaaaaacaatcttttatttcttaggataaatctgtagaaggacctccagacagtgaaggccactgactactttatactctgtaagccatccctccctggtaggaaggactatttccaatcttacagagtacctctcagcaaatagacgttttcacatatactgtgattcatacatccctatggctggtgacctctttaaaaaggaaaggaaaaagcctaatcaaacaaaaagatgctgctagtaattcttaccctattgtgaatcctatataagcaaatttgtatctttgttttttcctacattagcagatctatttgatgtatatctctgagtgcagaaaatattttatggaaaaatcaatatatggaatttcaaattcagaattgctgatacacactatttggtttcacaattttatcctaggaaatagtattagagatttcaatttctggcttaaatggtagaattaattactcttaactcttaattttacttctgagttgaggtcaaggaacaggcagacacctgcagttaacgtctatacctctccatggccaagagttttaattttctcgtcttcaattttgtagatgttcatcattactaaatggattgattagtattttatctcctctccttgtccttactttccctctggtaaatatgttataaacagtgtaaggctcctaagatagagtagctggtaggacttagaagagaaacaaagggcactgataactcacataaatggaaaattggctctggaataactgacaacatattcaagtattttagtgcagtgtcactctcattaagaagaagagaatcagtaaatctatgtgactctaaacattctaatgaaaaaaggaatattctgccaattatctcacatttctaaatatctggatattggccattgtaaagacaaaacatacagatgatggacttgtctttccacctctcatttgcatggtttggagcattgtacctccagccatagactctaaggcaatttatatttgcttcctcttccctcttgagagaaaacgaaaatcttatttttccaagcaattaaaactcttctgcttcagctaggatgaaagaattaggagttctgtctccttgtatctaattgcatgtttcatctttcttgttttaatgattgacagaaaactaataaactgagacatctttgaatccaggttgaatgtactctcttggtggccccattgctaatttgtttgactattttgcaggatttcttactctgtaatggaaaggtttattaaatatgaggggtgca

SEQ ID NO: 89209 - DNA, 669 bp, Homo sapiens
attaagttgctccccttaaaagtatcaatgaagaaacacaaacccatgagatctctggtctcgcctggcttcagaggcacccccaaccacccagagagcaaaagcctttgtcaagcaaggtggaaatgcctgccctgctttcacagctctggcactaacccaaggctggaatgttgagggcctgcattccaggctaaagcaaggagcgggtgaggccacccctgggctccagaggatgtccaggatctcctgaagtcctggcaaggaaaagatcttgattaacgagggagaggcaatgcctgctgcaagggaaccacacttgcacatttcaagagcctgaaaagcatccatctatgctcccagcacaaactcacagttgaatcatgcctctactatgttcacagaccaaacatacacactgagctggatgtcactgtagacgggctagctcacatctttccaaaaattctaaatttagccccatcctgacgggatccaggggtaaacctacaggcaattctagacactagaaagaaagtgcagaagaagacaaaactctgccctcaagaagcttagacacttcaccttcatactgggttaagcaccatcgccatcatcatcatcatcgatctttattgtcactatcatcactgttaccaaggcactaac

SEQ ID NO: 89210 - DNA, 367 bp, Homo sapiens
acaaacaaacatcctattccaaaaacacataggctttatatagggaatatgtgttattttctaaattcatagcttctttcctatatgttttcccaaatgcttgtttcacttttataaaaatcctccttaggctgggcacagtggctcatgcctataatcccagcactttgggaggccgaggcaggcagatcacctgaggtcaggagttcgagaccagcctggccaacatggtaaaaccctgtctctactaaaaataacaaaaattagccaggcatggtggtgcatgcctgcaatcccagctatttgggaagccgaggcacaagaattgcttaaacccaggaggcagaggttgcagtgagccaagacg

SEQ ID NO: 89211 - DNA, 235 bp, Homo sapiens
gggagagggagacaggagtgggtgtgggaaaagtgtttcagacagagggaacatgtagaaaggtcaaaaggagagagcatatcatattcagataactaacatgtagtttgtatggcttaatgtagagttcaagaggtgaacgcaccaggtggatatgggggtttggctttgtgagagtagtgagagctgagactagagaggtaagcagaagccatctcttggagagctttgtaag

SEQ ID NO: 89212 - DNA, 818 bp, Homo sapiens
tgatctagaggatccgagttagggctacctgcctgcaatgtaaagtcatagaggtgactatctgatttaaatcaagtcagtaactatctgatttatgcatgtttttaaatgttactccagctgctaagcaaagaatggacaaggagaagcacagagtagccgcactgggtggaagacgacacctgctaggtgaccgaatagagaaaagtgggttgactggagattcaacttagagggagaactaattggatttccttgctgatgaatgagacacagggaggtgagtaaaacaagaatcaagtacagactccgaatttctgcttgagcaaccagatgaatggtaacttctaaatttgagatgtccatcaagcatccaagtacattagttggatatgtaagtttatagctaagggaggccacagtttaagaaagtagcatggtacagtggggtctgagaacgccaaggttccaagatcctttctgccacttacctgtataactgggatcaaataaatgatttcattctcagttacacagaatagtggctacttagaaaaaagttttacaccactccaatgaagtcatcgtacaatgcctggcatatagaaagtactgttgttccttttaacattcaagagaatggcgctgtcaaggagagaaatgactgatacatatgttttgctctctgcctgctgggaagatggctacgaagcttatattcagaaaagtcctctgcaatatctttcattagaacaagatccataagagaaagccttctttagtatggttctctgatggggtagcccttaacctaagtt

SEQ ID NO: 89213 - DNA, 393 bp, Homo sapiens
ttctctcctttgtatggcatttgtttgtcttagaccgtgacgtcctgagagaaaactaggccccatttgtggttaggttggtttccaatctcaggggcagagagctgctttacataattgatgaaaactttgtttctgtttcctaactctcgattcagtgcttttttcacatactcccaagcttacatgtccttgctaccttcagaaacaaaacatggtattaaaagttgctgctggatattgggcagctgatatctgacctcatgaagcagaaggggagggtgaggaattgccacttgcaatagggatcccctgagcttccctgatactaacatggtgggggggggggcttgataaaaaacaaagggcaggctcaagagctcagggctgctg

SEQ ID NO: 89214 - DNA, 281 bp, Homo sapiens
tagcttgccaatttctgcaaaaaaaaatccagttggaatttttaagagaattgtattaaatatgtagatcaacttggggagcgttgccatcttaacaatagtaagtcttccaattcatgaacacataatatctttcattttatctttttcttgagacagagtcttgctctgtcacccaggctggagtgcagtggcacaatctcggctcactgcagcctctgcctccccgtttaagtgattgccttgccccagcctcccaattagctgggactacaggcatc

SEQ ID NO: 89215 - DNA, 443 bp, Homo sapiens
actggagtactcctagataaaggaactgcacagtgaatattcttttaggaatgacaacagtaataacaacagtaacagctaatgcttaccaggggctgacaaagtacttggtccagcattggcagtttaggggcctctcatgtccttctcatcacaatcccaggaggtagttattaccaaatgtgggcttgacctctgaatttaaaattgcaatttacccctggccctcctgctctccccttaacctactctacctttttttctttccataccacttattgcctcctaatacactacattattttcttatttattatgtttattgtctgtcttcatcccctcctgaaactgtaaatggtaaggtctccctatgaaagggttttgtctttttctccccaccgatgtattccaagtacttaggacagtccctggtacaaaggatg

SEQ ID NO: 89216 - DNA, 226 bp, Homo sapiens
accatcagttctacaatttaaaatttttttaaattttttcttttttacctccagaggaagttcccttgaatcctcttagccaaaaacaaaatatgactatcaaacaaaagacataaacacttttagatatgattaattgccaacgtaatatccaacacagcatatcacaccactttttaaaaaccagttctgccaggcacagtggctcacacttgtaatctcagca

SEQ ID NO: 89217 - DNA, 322 bp, Homo sapiens
gggcctttctagacaatcatgagccatgtttctgccaacccttgctgtatttgatgtgctttgatgtacttctactttgtgctttgatgcacctctacatcaaccttcgctgagcacaaggcaattccccctcctttgagtccttagattcccacccagtctgggaattcacgatagaaacacgacgggacacagaactaatataaccaagatgccaccacaaaattcagttaaatgtgctgaaacatgaggcggtaaactgtgtccccgactgtttcgggtttctgaaccagcagctttgtctacgaaacacacattcagg

SEQ ID NO: 89218 - DNA, 2010 bp, Homo sapiens
  misc_feature (871)..(871): n is a, c, g, or t
  misc_feature (882)..(882): n is a, c, g, or t
  misc_feature (1318)..(1318): n is a, c, g, or t
  misc_feature (1799)..(1799): n is a, c, g, or t
gtttgtaaaatgaatgggagtggttgcctttagaatattcaggtaggatgtttagtggatgttgtaaaagagcatctagagcttagaaaacaggaggaaaggttgagatttagaagtcatgagttttctaaaagctaaagccctgagtgtcaggagatgtgggttttaatgtagagtctgtcattatattgtcctggggtagtagtcacttctctggcattggcagtccttgtttgtaaaataaaactctagacttgatctcacaggcctctcccaactctgaaactttgttctaaagaagaaaatatattctcttaaaatttcgtgggctagtctataagggaaaaaagatgctttagcaatggtttggggtatatgatgtcatgaaagtaatattctttttactgtccaagtcagtaatttactgtgtagagaattggaaatggaccagaggcagtttcccagaataggtcattatttggtgttagtaattggtcattcacgcatctgcataccctttgtttccttaagtaactctcctttctggtaaccaccttaggtttgtcaaggtggaagtcatgtggtcaaatcaaatggaaacacaagtgtgttaggtattagattcattttcctgtccccaaagtacccgtttggtaatgctggcagaagacatacatgcggccaacaatcataggaaaaaaagctccacatcactgatcattagagaaatgcaaatcaaaaccacaatgagatcgtatcccatactaggcagaatggctattaaaaagtcaaaaaataacagatgctggcaagtttgtggagaaaaaggaacacttatacactgtcggtgggagtgtaaattagttcagcnattgtggaagntagtgtggtgattcctcaaagacctaaagacagaaataccatttgacccagcagtcctattactgggtatatattcaaaggaatataaattattctgttataaagacacatgcacatgtatgttcattgcagcactattcacagtagcaaagacatggaatcaacctgaatgcccatcagtgataaactggataaagaaaatgtagtacatatgcagccataaaaaagaatgagatcacgtcctttgcagggacatggatggagctggaggccattatcattagcaaactaacacagaaacagaaaaccaaatactgcatgttctcatttataagtgggagctaaatgatgagaatacatcgacgcaaagaggggcacaacagacactggggcctaccagagggtggagggtgtgaggaaggagaggatcaggaanaataactaatggagaatgggcttattacctgggtgatgaaataatctgcacaacaaacccccatgacacacgtttgcctgtggaacaaacctgaacatgtatccctgaacttaaaaaaaaaatcaaattgatagtctataaacaagctgccagaggctccagtgaaacctgggagctgtgggcagagcaagtaggctgtctctgttacactctgccacctcctagcggtagcagcttttagttcctgtgtcacagaattgaacattttcctgctttgcaaggaactttcaaaggctaattcgcctttactctcacctgcttccgtggaggaggtgaataaagcctgtatttcagtgatgtagtagtttcttaggctgctgtaacaaagtaccccaaatttggtgacataaaacgagaaatttattctgcacagttcaggaggccagaagtctgaaattgagatggcagtaggggtagtgcnaccttgggaggctgtaggggagagtctgttctttttctcttcctaccgctccagtttctgcttctgtggtcacactgccttttcttctctgtctctcctttgtacatctttcattatgaggacactgtcattggatttagagcccacctggatagaccagatgatttaatcttaagatccttactaacatagcgagaccccatctctacca

SEQ ID NO: 89219 - DNA, 356 bp, Homo sapiens
caaattaaatataaattacattttcaagacagctagcaatctattattttatctgggaaaatatcttctgaattctaatcaataaactttaaaaataaacctttaggatacccacatgttagagaatgttattgatgtattcaaaaaatatttcttgatcatcttctatgagtctaacactcttcccagaacaggacacggtgcaataaacaaaacagaccaagtctctaccttcacggaggttatcttatggaacaaatgtatttttacattgcttgttgttatccagcaatattttaccagggtcaatccctaactgacaaaacacgtcacagaaattgtctttccattaaacc

SEQ ID NO: 89220 - DNA, 3405 bp, Homo sapiens
agcgggcgcggtgcctgcgggcaggcgcggaggttgcgcggcgtcctgcgctagcagttcccggacactgcgctcgcgtcgcatcctcaggtggttgcagaagtttcgtggtgtcgggcgcgcgtctgcactgcagacgcagagggtttgggagcgagcagtttcctgcccagggatgggggtcctggctgcacttcacgggggcggccctttcgtttcgctctgcgtgacaggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacgttgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcatttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagtaaaaaaaaa

SEQ ID NO: 89221 - DNA, 3365 bp, Homo sapiens
cggggtccgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggcttggagacacatagggcaccgtacaacaaacttccagctccagaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacgttgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcatttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagtaaaaaaaaa

SEQ ID NO: 89222 - DNA, 1123 bp, Homo sapiens
agcgggcgcggtgcctgcgggcaggcgcggaggttgcgcggcgtcctgcgctagcagttcccggacactgcgctcgcgtcgcatcctcaggtggttgcagaagtttcgtggtgtcgggcgcgcgtctgcactgcagacgcagagggtttgggagcgagcagtttcctgcccagggatgggggtcctggctgcacttcacgggggcggccctttcgtttcgctctgcgtgacaggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaactggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtgaaactatgtaaaaatagtgtttctgatatttttcctactcatattaacagaccatggaaagatctggttgtagacatttttttttaatgtgaatgaataacatagtgttaggaaagagttaattaaccagttgacatcaaaagattttaaagttattgtgagtagattgaggttttccaaaatgaaagctttttttatgacttcagtacttgataaaaataaaaag

SEQ ID NO: 89223 - DNA, 3318 bp, Homo sapiens
cggggtccgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacgttgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcatttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagtaaaaaaaaa

SEQ ID NO: 89224 - DNA, 3244 bp, Homo sapiens
cggggtccgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacgttgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcatttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctgga

SEQ ID NO: 89225 - DNA, 3400 bp, Homo sapiens
cggggtccgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcgggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacgttgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcatttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagtaaaaaaaaa

SEQ ID NO: 89226 - DNA, 868 bp, Homo sapiens
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcaagcgagcaacgcttcaacaaaaacattttgggggcgcgcgggctaaaaagttttgaaccactcgttgggccgcgcggccctggtatcggacttgggctagggtcccaggagacccgggcagca

SEQ ID NO: 89227 - DNA, 943 bp, Homo sapiens
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaatgttttggtgtgggattatttgaaagcaaaagaaatctaattttgttttctccattacctcattttagtattaatttttacttggtataatatacatggttaaaatgcttatgtgacttcgagtaggtgaatcttaaagaaataaaattcaagtgaccacaaagtctgga

SEQ ID NO: 89228 - DNA, 769 bp, Homo sapiens
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaaggtgagagaaaaactgatgacatttcagcccttcaataaggatgaaagagtattcagcaaatgtagacataaagaatgggaaaacttacggacacagtgtgaatgctttgagccttgaatgagaaattaaatgggagttcagaatgaaaggatctgttgtcttggttgggtgtgtgttaagttttaccttgcaatgtcaactcttacaaacagtccaaaacaatgaatggtttaaagcatttttctttgtcctagagtacacaacaagtttctttctgattaggtatggccaaggctaatgttaaaattagattttattctttgagtaaataatgactgacaaaaggggaatgttgcctaggaatgtaatgtatggcagaaaaataggtttggtctaaagctttgccagcagtgttcgaagaaagtaggtaatttgttcaaggataagagacttgattctttgaggtacagcctggccttaaaaaacaggtacataagtcgtagagtataaaacagtatgtggtgtg

SEQ ID NO: 89229 - DNA, 574 bp, Homo sapiens
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaatgttttggtgtgggattatttgaaagcaaaagaaatctaattttgttttctccattacctcattttagtattaatttttacttggtataatatacatggttaaaatgcttatgtgacttcgagtaggtgaatcttaaagaaataaaattcaagtgaccacaaagtctgga

SEQ ID NO: 89230 - DNA, 430 bp, Homo sapiens
acagatctaataatttatgttgccaacttgtgcttgtatgttgctaacttgtgcttggatgttgatctgttgaaagtcatgctgttttttttgtattttgttttctttccatagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgaggtgggtggcactgtatcttgccttatgtggattgtaaaacaagaattgatttgaatactttgattgttgtgtgatttctgaagttttaatttaatgaaatctttcgaaactagaatttctattttctgtaaatattaaacatgaaattttattgtttgcattttg

SEQ ID NO: 89231 - DNA, 513 bp, Homo sapiens
agctgccgccattccaggcctctcctctaccaaagtgttgtctttaatatgctgtatgtggacaggtagaagggctatacaatgaaaaggatgcttgaagtacatggtgcttccatgctgaggtcaatgattatctctgggatgaaggcaaatgtgcaaatgtgggcacagtctctgcacattgtactgcctttaataatttgccagccgtttaatatggagagcctatcacagtaatattcacctttgtttattctttagattgaccctgctacgggaatggttatgaatctggctgatctcaaaaaatatatggagggatgtgccatactttgcagatgtggtgaggtgggtggcactgtatcttgccttatgtggattgtaaaacaagaattgatttgaatactttgattgttgtgtgatttctgaagttttaatttaatgaaatctttcgaaactagaatttctattttctgtaaatattaaacatgaaattttattgtttgcattttg

SEQ ID NO: 89232 - DNA, 763 bp, Homo sapiens
agctgccgccattccaggcctctcctctaccaaagtgttgtctttaatatgctgtatgtggacaggtagaagggctatacaatgaaaaggatgcttgaagtacatggtgcttccatgctgaggtcaatgattatctctgggatgaaggcaaatgtgcaaatgtgggcacagtctctgcacattgtactgcctttaataatttgccagccgtttaatatggagagcctatcacagtaatattcacctttgtttattctttagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttca

SEQ ID NO: 89233 - DNA, 891 bp, Homo sapiens
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcaagcgagcaacgcttcaacaaaaacattttgggggcgcgcgggctaaaaagttttgaaccactcgttgggccgcgcggccctggtatcggacttgggctagggtcccaggagacccgggcagca

SEQ ID NO: 89234 - DNA, 768 bp, Homo sapiens
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttca

SEQ ID NO: 89235 - DNA, 688 bp, Homo sapiens
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttca

SEQ ID NO: 89236 - DNA, 745 bp, Homo sapiens
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttca

SEQ ID NO: 89237 - DNA, 689 bp, Homo sapiens
  misc_feature (683)..(683): n is a, c, g, or t
tgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgcctcggccgcacccgctagccgattctgcaattctccctgggcggcgtcactgctctaagggcatccttanggagtc

SEQ ID NO: 89238 - DNA, 237 bp, Homo sapiens
attatggaaatcccactccccactcatccttcaaaaggctcgggacaaaaggcacattctccctgaagtcggctaccctcccgactctgtaaatttggaataaatcacatctttcagcttctatagcactcaccctgcatctccaccacagcccttatgacatagctgttgagaaaggtctgtcttccttggtagatgatgaggtcattgtggaaggttcgagtcgtgggcaagaaa

SEQ ID NO: 89239 - DNA, 335 bp, Homo sapiens
tgctgcagggcctgaagccagctaatggtggggcctgatttagtgagaaccggtgtccttgcaaatattctgaaaatatccaacccttaagagtgaagtgaaattcttccaaataatgactggatgcttttaaaacttaaaagttttaagttagaaacataataggtagcacagttaagggctcagaatttggcaccttttttttctctctctctccaaaaagctaatggcaggagctgacttcattttctttaaatagtcttgaactgagttggatcagatccatttttgcctaagggtatttatgctgcaggcccattgtcctggtagtattg

SEQ ID NO: 89240 - DNA, 749 bp, Homo sapiens
agaggttgcagtgagctgagattgtgccactgcatttcagcctgggcaacagagcaagactctgtctcaaaaaaaaataaaaaattgcattgcatacagttttcactgtaaccctaatctttcctcatgtgtagattagaataaattttttagacaaaacctttcatcagtattaaacattctacagattttatgatatcattagcatttatctttatgcatgtgttatataaaaatatttaaagtaaatgtattttttaaatgttatttccattattaatggattgatactccttaagtagagcattcacaaccttttagtaatatttgggaaatatgtttggtctcattattagatggtattacatctcaaatgatgttcctgttgcagaagtctgcgaaacaatatctaaacttggctgcagttgagagctaaacagtgtattgaaccagttaggagtttagttctctgtagaaaaccagaggcagtccagggctgatgtaggttttgttccacattctttaggatcctaggctccctccatccctggtatgtggtcctcattttcatatagaccaagagctagagctccagttaccatttcttaaagtatattttaatgccaaatagtgaataaaggtggccagaaaattcatgcacagaatccttctttttctcattttgtgctgattggtataaattttattgtatttgtagtctctggaaatcttctaactttgagaggaca

SEQ ID NO: 89241 - DNA, 489 bp, Homo sapiens
gcagccagcccacaagggtgctgctccggccaggcagactgtgtccacgcgcccgcctgccaggggatagggaactgggataaggcctgcctccctccgtttaatctgggaagttaaagaggatgagggccaagagcatctgtacctggagccatcatcattggtgcccaggcctggcactcaccaacgctgacagcaacatcaccgtggagcaccccgatgtggctgctgtgcccagatgcaggagggtgattctccaggtgcctcgcctcaccccatgctgtgcaggcccaggaatgacatggccccagatggctgccctagccccatccaagacgggtctttccaggtgggctggccgctggctgccccctcccatgacctgagctttaccaggccccacccatcatgatctgggctggccgggcactgggaaaccatgaagaaactcaggaggcctcgggaaagatgtagtgcttcaggggcacg

SEQ ID NO: 89242 - DNA, 354 bp, Homo sapiens
tgactaaacacaaatattcgctccacaaaatgcctatcctgtcccaacaatgatgtaagcatttccttcatcataaatataaaatgccccgaatttagtcgtagacttgacatatctcgctcttttccaaataattgtaaattctgtacaaaacacacgcaccaaaaaaatgtcaccaagatgcaagaggacgtaagagggagtcaaccttggaactgggccaaccgccgcctgcattactgggaagccactgctgccaagcaaaggtcaggcattcattcaggcaacattttttccaacaagtgcttcacactcgcacgcacacacacgctcctttaaaagtcaacaacaatt

SEQ ID NO: 89243 - DNA, 637 bp, Homo sapiens
  misc_feature (591)..(591): n is a, c, g, or t
agccggtgcccctcccccagcctcgctgccgccttgcagtttgatctcagactgctgtgttagcaatcagcgagactccatgggcataggaccctctgagccaggtgccggatataatctcctggtgtgccgtttcctaagcccgtcagaaaagcgcagtgttagggtgggagtggcctgattttccaggtgccgtctgtcacccctttccttgaccaggaaagggaactaactccctgaccccttgcacttcccaagtgaggcaatgcctcaccctgcttcagctagtgcacagtgcacttcacccactgtcctgcgcccactgtctggcactccctagtgagatgaacccagtacctcaaatggaaatgcagaaatcacccgtcttctgcgtcgctcatgctgggagctgtagactcgagctgttcctattcggccagcttggctccttctcccattattttttaatattttctgaaaatcttctttaaagagagaaagccaaatgtcacccactttttcataaaaccttataggcaaatctattattcttttcttttcttgaggtggattttccctcttatgggccgngccgaatggggatctctagagtgactgaggatgcagctggacggcg

SEQ ID NO: 89244 - DNA, 518 bp, Homo sapiens
actttacaaatgaggaaagagattgaggggccctagagatgtgctcagagtcacctgtctggacagctggtgtcaggccctacagcccatgtttttaccactgtataactaacaccatgcgccgacacgttgctggagcaaacgggcaaaagttaccttaggtaggtcccctgccccttcccgctttgtccctaagatgctcccaattcaccttttaaccaaaaccagttcccaggtcagctcttccactacattttaccttttggtcttctagagaaaatagttacagagttccccacgcaacagcccgctcaggtgcctgttccttagtcaacctccaagaacttttggccaacaaaccagttcccttcccagaaccacccctggttgggcagaggcaggaccattgcagcaaagaagtcctacagagcaatgacatggcccagcgctgctccctatgtgctagtgctgggactggcgtgccctccatgtggcacaacactcctgacactcatgct

SEQ ID NO: 89245 - DNA, 1755 bp, Homo sapiens
tttatttttcagtctggaggctaggaagtgcaagataaaggtgccagcagatatagtttctggttagggcccacttcctggtttgcagatggtcctcttcttgctgtatcctcacatagcaagagcagagaaaaaaagcgagcgctcatgtgtctttttataaggacactaatcctgttcatgagggcactacccttatgacctgattacctcccaaaggccccacctcctaatgtatcatattgcaggttaggatgtcaacacatgactctggggtgatacaaataggccattgcagcatatacaattaaaatgtaaatatgaagaaaaaaggaagtttttgtttttttgtgggggagatgggggttaaggaagaagatagtaatttcaggactaggcatggtagctcatgcctataattcctgcactttgggaggccaaggcaggaggatcacttgcggccaggagttcaggaccagcatggttaacagaggctaaggcaggaggattacttgagcccaagagtttgaggctgcagtgagctgtaatcatgccactgcactccagggtgacagagcaagaccctgtacctaaataataataataatttccacttcatttttcaatattcaaatatttttatataattctgcattgttctgtatgtagatcctaattttaaaattttacaccatcataaatgaacaaaggtaggaaggagtttggcttcaatagcttacagtaaaaggagtaaaggagttcagcctcaaaacgatattgttgacctgttatgttatgaaaaataatccagtgtttatacttaacggatgccatcccttattatttactattttcttagtctaactaaacaatctttattaaaataagcaatgatatttgacatgggcctaagaaatatatagttagctaacaatattgtcagttagagggatttcttttctaaattaagtacagatttcttcaccaaactccaggataacagaaaagaggacataaaatttggacatagtttctggataaataaatgtaaatttaaatataaattatgtaacaggaaacaaacgaaattaaagaaaataaatttttcaagaaaagtaaatttatggatgttaattctgtaacattgtcagggcaaagttttttgtttttattttaatttaagggttttatgtttgttttttacttgttgcaacctcaaatgaccaaatggtatgatgcacactgagatactcaataaatgtgcagtgattcttagccttttttcctagaactttaatattaacatggaaaattctgaaatggacaacaaaaagataacactttgtgtatggggaagaatatcatgcagttgatgacggtacattaaaattcacacaaaaggacattttgactagcattcagaaagagtccattgattataagattatctatgaggttttggaccgggcactacactaccgaattatggctaactttggtttgtgatctagaccaagtcacccaatctatcttggattttagttttctggtttatgaaattaaggagttaagctaaatgacttgggtttcttttcgtgtatcataatcaaaatgctgtaacttctctagtgaattcatagaacactgactcttacaagtatgtcatgaaatactttatgctgtgagcaggtatacatgtataatatatgtatagctatgaacaaataaattttaaataaatgcacaacgaattct

SEQ ID NO: 89246 - DNA, 781 bp, Homo sapiens
acagcctctcccagccccagcaagcgacctgtcaggcggccgtggactcagactccggagatgaagcccctgctcctggccgtcagccttggcctcattgctgccctgcaggcccaccacctcctggcctcagacgaggagattcaggatgtgtcagggacgtggtatctgaaggccatgacggtggacagggagttccctgagatgaatctggaatcggtgacacccatgaccctcacgaccctggaagggggcaacctggaagccaaggtcaccatgctgataagtggccggtgccaggaggtgaaggccgtcctggagaaaactgacgagccgggaaaatacacggccgacgggggcaagcacgtggcatacatcatcaggtcgcacgtgaaggaccactacatcttttactgtgagggcgagctgcacgggaagccggtccgaggggtgaagctcgtgggcagagaccccaagaacaacctggaagccttggaggactttgagaaagccgcaggagcccgcggactcagcacggagagcatcctcatccccaggcagagcgaaacctgctctccagggagcgattaggggcaggggacaccttggctcctcagcagcccaaggacggcaccatccagcacctccgtcattcacagggacatggaaaaagctccccacccctgcagaacgcggctggctgcaccccttcctaccaccccccgccttccccctgccctgcgccccctctcctggttctccataaagagcttcagcagtt

SEQ ID NO: 89247 - DNA, 146 bp, Homo sapiens
cctgcgccccctctcctggttctccataaagagcttcagcagttcccagtgactccgcctgtctgtggggtccctcggggtgagaggtgctggctgggtgctcttttgggtgcagggactgggtgggaagcaggaggaaggacagg

SEQ ID NO: 89248 - DNA, 255 bp, Homo sapiens
taactgtgctgcgtctaattctggctttgtccttcctggggtggtggagctggtggctgatgaggggccccggtcctgactgcattcctggggtctcctaacgcctgtgcttccttttcctgcagaaacctgctctccagggagcgattagggtgagtgaacagctttagaggacatttgagaaaatccagttctggggctcagtggtgcttccagaggccatggggtctctcccacccatcccactcctacctg

SEQ ID NO: 89249 - DNA, 641 bp, Homo sapiens
ccagcctcccatgctctatgcatccattgctccagaagatagactcttaggataaagagttgacaccatctccaagcatcccaaacagcattgtgtacttatatacatgattagccactttggaatgtctttagtgttaaggcaagaaatgtccttagagtcccagagagggaaaaaatgtgggttatgttatgtccaaatccataaccaccacttcagggagttgtgcagtgaattgctttattgaataagtgtgagaaaggaaagatattagttgtccaagaatgctattgccaaactttgtggaaacagagtattttctgtggaaacagcatacattttattctgtgccatggaatttcccctcatttgacccaaggggtaaagaaaaactcttatgcaaccatcccattttaaaagttattcttttatatgtaggctggttaataaccaacaacagacaattttatctaagatgactaagatcttgcatttcgcttttagtgagagctgatttacatatctaattcatgttctattagcagagttatgggaatataaggaaatgcaagaaaaacccaggacttggatcagattttaaagtcctacagttatatacagttgtgaagatgtccttcaaa

SEQ ID NO: 89250 - DNA, 402 bp, Homo sapiens
cctacctccaaaggatgtaggagcagtgaactagagtgtgagagagcagaaggttgatgtttgccttctgaacaagctgaatgacatatctagtctagctgcatgacatgttttcaaaatgttttactatgattataaatagtactatgtagaatcagataaagaatgtctaccacttagacacttgattacttttttaaaattgtggtaacaaatacataacataaaatttaccatgttaatcatttttaagtgtacagctcagtggttttgaatgcattcatattttgtacagtcaatgtccagaactttttgtatcttacaaaactgaaactctgtactcattaagcaattccccattaccctgtctccccaacccctggcaaccatcaatctgctttc

SEQ ID NO: 89251 - DNA, 345 bp, Homo sapiens
ctagagggagttacagtcaagttttgcaaggggagtgagctgttcatgggcccagggtgggcagaggacacacatgcaaaggcacattgtcccggtatggtgaagtgtggcactcacagctgtctgagggacagcaggtcgtccagttgactccaagcttgataacgcgtgtaggggccgtgaggccggcgcaggaggcctgggtcttttcatgtgggttagtcccttagaagtaaacaggctgcctcagttggcttctcccctctggtcagttgtagcactctgaggcactcagtctggcaggaagagggcagcccccaggtgccagtctcaggacattgcttt

SEQ ID NO: 89252 - DNA, 271 bp, Homo sapiens
gtatatgtgagtatgtgtttttatgtgctcatgtgtggtttccttactgatggaaagacagagaccccttcatgtttattctcacagtagcccacactgtgcctggtgcacctggtcaatacaccatgaatggcagcaaaaggattattcttggctgggcacagtggtcgtgcctgtaattccagcactttgggaggccgaggtgagtggatgagcccaggagttcagtcaataccagcctgggcaacatggccaaaccctgtctctacca

SEQ ID NO: 89253 - DNA, 128 bp, Homo sapiens
gagctaaaagcccatcctgttaacatgaaatgtgttcatatcacttgaggagcctcctggtatctatgattactttcagaactcacatgtccttcccaaatggaacttaataggagaaaggagagatg

SEQ ID NO: 89254 - DNA, 956 bp, Homo sapiens
gtctatcatttctttgtcttaggaatgtcaccaaatacaaaatgctcaactttcaggtaaccataggtaggatgagaaaaagctgtgatactattggcctcaggataaattattagaattaaatatatagaccataatagacctaagaatataaaagaattgggtatattataaaaatgacatttcagatctatcagaaaagtttggattattaatttatattgggatagctggttagctatttcttgagagaaatattagacctatacctcataatttttatcagaataaattccagatgaaataaagatttacatattcaagcacataaataaacatacaacaagactagcaggcaatgtgaatggatatttatataattttagtgtgaaagaagcctttctttgagtgacaccaaaggaaaaaaacagaaagaaaggatggatggaatttgactgattaaaaatgctaaactcctatatagtaaaaaataacaaaccaaattgagaaaacaatatatgctacaaaaagtatagatctcaaatacatattaagagcttaaacatcactacttttgggacatttccatgatctacaatccccttctcaaccaagtgtttccatttcattctttccttattgaacgttttcattattgcttgtttaattgcctgtttatccctattaaattggaagtataagaaggcagcaaccatgtctattttgcttattgttgtatccataacacctaacacagtgctacacaaagcaaatgctgaaaacatacttattgaatgagtgaataatgaatgaataaatgacattttataattcaaggagaatcaaactttccaacagaaaattggaccaagaacacaaactggcaatgcacaataaactaaaataacctactaataataaatatgaaaaagtgttttaatatactagtaataaaa

SEQ ID NO: 89255 - DNA, 732 bp, Homo sapiens
ggcaggctggtacggcctgggatttagggatatgagatctaaaaaaaaaaagaaacctgtgtattggctcagcattacccttattcctctcagccaagtgcaagggatcacttactcaaatctttattcatcccactagagtttaatgacttccttgaatggctgttcaatgttcagtgacaggtctggcttttgttgtgaggccatctatggagtctctgggacccttccagtccctggaatcagtttggtctgagaggtcaggacttggaaacatactggaggcagggcaagggcaccctgctcttgttttggcatctacctcttttccgctggtccttcttatccatccaactagtccttttccctgagccaggtccatactttcccaccccaaacccttcctcttgtttcctggctctctgtttctggctacattcatttcctacactcctgtatcaaaagtaccacaattgcttctcgttcccacagtgcagtgcggctgagcgcctcagagcccgcggggacgctgcggggggattgcggggagggggcgttgggaggtgccgatgttgggctgggcggatgagcgcatctgcgtggtgagccttccaacgtgcgcgagaaggacgtggaagaccttttctacaagtacggccggatccgcaagatcaagcttaagaatgggcactgccttgtgcccttcgccttggtgcgctttgaggacccccg

SEQ ID NO: 89256 - DNA, 636 bp, Homo sapiens
taacatcttacaagagatgagccagaaatccagttttaaaaaactaaacaagagaataaattattgtatgcaccacaggctgcacttcctaaaatgaacagagtgcagaaattagaactgattcatgttcagaggcatatactgggttatttaaaatatgattagtttaaaaaccttgtctgctaaggaaaaaaatcagtgtggaggctttaaaataatctattaatcccaagaccctttacaataaatttgccaagcaaatttatgatatttcagtcacaagtttaaaaacaagttcctgataaaaggaaaattctacttccttcaaaaaaaaaacaaaaaacaaaaaaatcaagaaaaatgcaaaaaataatcccctgaatcatttagtcaaattccatgagagaatatattctctaacaataaataaaccatactacaaattcagtcatcacacaccagatgagaaatcacaaacataatcaagaggaagatttaaattagccaagtgcccccaaaccattaacagctgccaagtatagttaataatgaaaattagcatatccagcaaaattagttttcaaaattttaatacaacacatttacatctcctaggtagaatattctcttagttca

SEQ ID NO: 89257 - DNA, 521 bp, Homo sapiens
tctctcttggctgtggccctcgtaaatctcaccacagcctttcttggacctgttaatcacttgagaaaaacaggactacttctgctttgcagggctgccttgtgcttggcacagttttctagcttgtacctcttccacggatgagaaaggagactagagttcctagtaacagcgcttgttccgcactttcaaaaagaagcattcaggggctgctcttgtgttttgtctctacagcaaccctgttgggaggcactattattattttgcccatttttatggatggcacagttggggctcagaaagtgtaagcaacctgttctcaggtcaccacctaaaaggaagcagcggtgaaggcttcagcttcccagatcttcacactgtcactctgctgagatgccttttcacgtggatgctcctacttaatatatcttggtgggttttcatagtcccaggttggcgtggcaggtgaggcacagccaatagaggtggaaatggtagaggcatttctggttaagtaccca

SEQ ID NO: 89258 - DNA, 288 bp, Homo sapiens
ggatggagggaaaagacagatgattagaaccgcctgatatagcagaagtgcttccacactgccttgatattccttcttcaatgcactccacttagagcaggcacccagcaagtattagttaaagggatgatggagccactgggaagaccacaggaactcacgagggcagtgtcagtgggagaagcaggaggaaagagtgtggcaaggtgtgatctagtctcttaaaggaatatgggaagaaatagagctgttttgcccctggctgtgatggaagtgataaaaactaat

SEQ ID NO: 89259 - DNA, 434 bp, Homo sapiens
ctgaaatctaaggcagggctgaaggaccatgattctgactcatctgagattttccttcttacaactcagtaatcatggcgtggagggtgcagcagtgtttaggtcaaggtttctcaacagcagcacattggaaattggagatggataattcttgatgtggcggaaggggactgtcctatgccttgtaggatgtttggcagcttccctggcttccacctgtgtgatgccagtagcaccttcatttgtgacagcccaaaatgcctccagacattaccaaagttcccccaagggcaaaattactcctggctgagaactactggttcaggttaacactgctgctgctacatcttctccttgggccctcatgtggcctttggtcccctgagactcggtctcatcctagccaagtgaagtgtaaccatgtctggactaag

SEQ ID NO: 89260 - DNA, 262 bp, Homo sapiens
tttgtatttttagtagagacggggttttgctatgtttgtcaagctggtctcgaactcctgacttcaggtgatccgcccccctcaggctcccagagtgctgggattacaggtgtgagccactgcgcccagactgagagtgttttatctaccctgtggattgtgttgctaaatattgtagctgactaaatgagagccagtattacaagaaaaggaacccaccgctttttttgcaatggtttatttataaatatgtaactttctc

SEQ ID NO: 89261 - DNA, 378 bp, Homo sapiens
cagttggaattttgttctaaggatgatggaagccattggaaggttttctttgccaaagtgatgtgatctgatagaaggttttatgaagcccacgttgtctactgtgcagagaatggagtaacaggccaagaggaaccgtagggagaccagttaagaggcagagacagtgaagaggcaaatataatttctgacctacgtaatgatgtatgcacaagaagcctctcttgaatgtattaattcagtaaacagttatggagtccttacaatgtgctagtgggactttgaagatgaatccaaatttggatcctggcctggaaaggctcaaagcccaatatgggagggtctcactcttatcttcgttcttctccccgcactccc

SEQ ID NO: 89262 - DNA, 756 bp, Homo sapiens
ttccaggccaggcccctggtccccaggagtgcggggatgcctgaggtctactgctgccttatccagagctgccatccccggcgatgactcagagttcctgtggccccagcatcatccctccatccctggctgtgaggcaggagcagagttgcagacctgagaggccttgaatttgtttgatataggactttgccaccagacaaagtgctttgcctgtgaggtctggcttggcctggcctctgagaaagaacaaacacagacctcactggaaggaacctggagaacgggagaggagaggctgctgctgtctgccctcccagcagcagatataaagacaatgggcttctaagtcccctagagtcccagctgtgtaatttaaggcaaatataatttctgacctacgtaatgatgtatgcacaagaagcctctcttgaatgtattaattcagtaaacagttatggagtccttacaatgtgctagtgggactttgaagatgaatccaaatttggatcctggcctggaaaggctcaaagcccaatatgggagcctggatacaaatgtgaaacttatcttcttttattaaccaatcaatcacctcctgccaaaacaacatcagcaaaaacaacagaaaaaaacaaaaacaaaaacaaaaacaaatctgtgtacacaagacctttgtttccacagcagacttggctaaaggtttgggcatgcatatgcatacccccaaaattaaaaatggaaaattgaacactt

SEQ ID NO: 89263 - DNA, 1067 bp, Homo sapiens
ttccaggccaggcccctggtccccaggagtgcggggatgcctgaggtctactgctgccttatccagagctgccatccccggcgatgactcagagttcctgtggccccagcatcatccctccatccctggctgtgaggcaggagcagagttgcagacctgagaggccttgaatttgtttgatataggactttgccaccagacaaagtgctttgcctgtgaggtctggcttggcctggcctctgagaaagaacaaacacagacctcactggaaggaacctggagaacgggagaggagaggctgctgctgtctgccctcccagcagcagatataaagacaatgggcttctaagtcccctagagtcccagctgtgtaatttaagatagatccccagctgggttgaaaggaacgtcaagacccttcctttcttatgacctatgtatcaactcccttctaccttgcctccctccacttggagcgagttctagttggtgaaatgtagccagaggttcctggaaaggctttccttctcaagtaaagcctggctcagagaaaaccactggtctctttccttttcttcctcctgacatgaacatggggcaggaaggagcatggagaagacaagaacaaggctctcagaaggaaatggtgtggctggagccatgagaactggttgtggagggggtgaggaaggcaaatataatttctgacctacgtaatgatgtatgcacaagaagcctctcttgaatgtattaattcagtaaacagttatggagtccttacaatgtgctagtgggactttgaagatgaatccaaatttggatcctggcctggaaaggctcaaagcccaatatgggagcctggatacaaatgtgaaacttatcttcttttattaaccaatcaatcacctcctgccaaaacaacatcagcaaaaacaacagaaaaaaacaaaaacaaaaacaaaaacaaatctgtgtacacaagacctttgtttccacagcagacttggctaaaggtttgggcatgcatatgcatacccccaaaattaaaaatggaaaattgaacactt

SEQ ID NO: 89264 - DNA, 379 bp, Homo sapiens
ggcaacacagcaacaccgcaatctctacaacaaataaagaataaaatgagaaggccaaaaacaatcaatagtcatgagtttagttttttaatttattcaaaaaagttattaatagtgtctcattgaacccagcatgatataaagtgttcagagaaatgtgtcatgagtttatactccgtttttttaagggaaaaatgtatgtatgacacaccaaaagagctagtcgacaaaaactatgaaaagagagagactcagcctggaacaatcactaaagacaaaccagaagaggaaactaaagcaagaatgggattgaggtgagcacagagaaggcagctttccagaagacagacagaataaaagtaatgaaaccgcaacttca

SEQ ID NO: 89265 - DNA, 430 bp, Homo sapiens
gtttctacggagtgtttagatgtgttttagattgagagtttttcagatgaggaagatgactaagtaaaataaatgaaagagaaaattttgctatttcatagtgaaatagaaaagggcttttttcccccttttgctagtagtttaaaagtgacgagaataagtcacatgaatacaaatcttaaaactgaatagaattttgtttctcataggtcatatcatgcctgggaaatctccaagttctttatggcaatatatcagggaatgcagtgacattttcagcatatactgttgccattatttgtgtgtgcatatgtgtagctttggtgattagaaagtcttttattaaaagatgaagtgtggggtatggcacaaaggatttactttgcctcataaaaaggctactggaattttgacttacattttactgtgt

SEQ ID NO: 89266 - DNA, 382 bp, Homo sapiens
agcaaatgggacatgtgccaagtgggcaaatgagggtctaagtcaacatattttactccagaattttctcctcaccacatttcttctcattctggtcattggcagtctgtgacaacaatacttcctgaaaatgtgttgcagctgtagagtaattccatagcagatttattttcctttggcactttttgtaattggcattgaggaaacatacaagaattattccttatcttttttacgttggcaagttttatattgtttaaacgatttctttagttgtgtaaaatatcatttggtagaatattagaagaagtttgggctttcaagtttgttgatttgagtgagaggtatattgaccagttttagcacaaggtagaatttaatt

SEQ ID NO: 89267 - DNA, 145 bp, Homo sapiens
tttataatagatacactagttatactgggagagcatatgccaagggaatgtaatcttttttgttttaaatagagacacagtctcactctgttacccatgctggagtacagtgatgcaatcatagctcactgcagcctcgaattcc

SEQ ID NO: 89268 - DNA, 664 bp, Homo sapiens
ccccttcctgtgtccatgtgatctcattgttcatttcccacctgtgagtgagaatatgcggtgtttggttttttgttcttgcgatagtttactgagaatgatgatttccagtttcatccatgtccctacaaaggacatgaactcatcattttttatggttgcatagtattccatggtatattagtatgctacatgtgttacattaacacacaaatattggtacaggattattaaccgaagaccctagctcattcagatttccttagttttgcctggtgtcttgttctagggtcccttccaggaccccacatgctgtttagtggtcctgtttccttaggctccccttgactgcagtagtttctcattttccttgcttttgatgagcttgacagttttcaggagtactggtcaggtatatggcaggacgcccttctggtggaaatgtctggtgtttttctcatgattagactgggtatatggctatttgggaagaggctcacagagcaaggtacttttcatcccatcatatgaagggcacatactagcaacaggatttaccactgttgatgttgaccttggtcacctggctgaagtcacctggtggcaggtttctccactgtgaagctgctctgtctcacccctgccttttccatgccctttggaa

SEQ ID NO: 89269 - DNA, 257 bp, Homo sapiens
cctagatgtttacacaattctagaattttaacagaactgttgaaaaacccaaggcttaagtcagttagggagagaattatatctcacagccaagagtgttaaatactgagccctaaactggggtattaatgtaaccttagttcctgatagatgtaattaatataatcccaattccaggatgaaatcctttatattctagaatatagttgttcaggtgtgaaattgatgaatgtttttgctgagagttgggccgtctg

SEQ ID NO: 89270 - DNA, 1713 bp, Homo sapiens
ctgtgcgtaggtttagcacacccatgttagcttgtccacattaggccttcttttgaaggtactgtatctaaagataagggcataagtgatcatttaattctcagccacttcactgatactacaaggtgttacacagtaattatagtggtttgatacagacatttgtttacaagaaactgaattggcattattaacttatttcacacaaaaaaagttagctttacccatgaactgtaattcagattgataaggtgacctacccatgaaaaagacacctgagacctgtttacttttttaaactatgaagtgaaatcctcagttcaataagtgtcccaaggagaatttcctctgttaaattttccctgttaacttagtataattggttttcttgaatagaagaataatgatttctgtaagatattttaatgtgaatatttttgctgtcttcatctttaaaaattaaatacagtactatatatagatattaaaattttaaagtgggactaggtgtttttatgtatacaattacagtttgtctcctctctttgcaaatttactggctattatcagaataaaggttggactcattttgcttatcccagtcattaaaatgttgtgatctgtttctaacatatttagcatttcatttttaaaatgagatgtgccattatcataacaaaggcaactattaatgttcctagaaaaaatgatgtaaaggacttactcctagtcaatattaacacttaatcccactttcttttttccaccaaatggcctcagtacattgccaagagagtgaaatttggattcctcacagtactcagaacacaatatgatatttgtcagctaactttccatcatgtcttggtaaaattgctcagttaaatataattggccatctacttattaaaaaacaattcaaataatctgtacagttaccataatttgacaacaaattactttaaatttagcaccatcttagaaatcttcttaatataaactactgattgaaatgtgtttatactttctatcatatttcaaactgttttactttccttgcattaagacaattaaaacacaaactacatgttagaatgaataatttaaaggacatgctgctgtttcagcataaaaaatggtaaagtctttataaatagaatacttatgatagccattaacgtattgaattgtttaattaacctagttgtgattttccgaatttaagacgttttcttactacatgtgttaaattgttacctataatatcttcctggaaaaatagaagtatttgtaaggtttttataaatgcacaatttatgtataaatataattggaatctgggatgactcttagtaatctactattcttaattcaacgatggccaccagctacctgacacattttgtaaatttagcatctgtgtatgtgtgttcgtgtatgtgtgtgtgcgtgcatgtgcacattactgcatttattctcaaatggatttataatttagtgtttttgtacaagtacttgagctattcatgtaatgggataagttgccataaagatgtacataaatgacccttaatttggcacgttttcacatttaattttttaaaatacagcttttcatatacagttcctaccctttcatttctagcctgtacttcattacttgttgaaaaagtcaagtttgtatgaagccagcataaacatcaaaatataact

SEQ ID NO: 89271 - DNA, 1801 bp, Homo sapiens
  misc_feature (1706)..(1706): n is a, c, g, or t
  misc_feature (1719)..(1719): n is a, c, g, or t
ctgtgcgtaggtttagcacacccatgttagcttgtccacattaggccttcttttgaaggtactgtatctaaagataagggcataagtgatcatttaattctcagccacttcactgatactacaaggtgttacacagtaattatagtggtttgatacagacatttgtttacaagaaactgaattggcattattaacttatttcacacaaaaaaagttagctttacccatgaactgtaattcagattgataaggtgacctacccatgaaaaagacacctgagacctgtttacttttttaaactatgaagtgaaatcctcagttcaataagtgtcccaaggagaatttcctctgttaaattttccctgttaacttagtataattggttttcttgaatagaagaataatgatttctgtaagatattttaatgtgaatatttttgctgtcttcatctttaaaaattaaatacagtactatatatagatattaaaattttaaagtgggactaggtgtttttatgtatacaattacagtttgtctcctctctttgcaaatttactggctattatcagaataaaggttggactcattttgcttatcccagtcattaaaatgttgtgatctgtttctaacatatttagcatttcatttttaaaatgagatgtgccattatcataacaaaggcaactattaatgttcctagaaaaaatgatgtaaaggacttactcctagtcaatattaacacttaatcccactttcttttttccaccaaatggcctcagtacattgccaagagagtgaaatttggattcctcacagtactcagaacacaatatgatatttgtcagctaactttccatcatgtcttggtaaaattgctcagttaaatataattggccatctacttattaaaaaacaattcaaataatctgtacagttaccataatttgacaacaaattactttaaatttagcaccatcttagaaatcttcttaatataaactactgattgaaatgtgtttatactttctatcatatttcaaactgttttactttccttgcattaagacaattaaaacacaaactacatgttagaatgaataatttaaaggacatgctgctgtttcagcataaaaaatggtaaagtctttataaatagaatacttatgatagccattaacgtattgaattgtttaattaacctagttgtgattttccgaatttaagacgttttcttactacatgtgttaaattgttacctataatatcttcctggaaaaatagaagtatttgtaaggtttttataaatgcacaatttatgtataaatataattggaatctgggatgactcttagtaatctactattcttaattcaacgatggccaccagctacctgacacattttgtaaatttagcatctgtgtatgtgtgttcgtgtatgtgtgtgtgcgtgcatgtgcacattactgcatttattctcaaatggatttataatttagtgtttttgtacaagtacttgagctattcatgtaatgggataagttgccataaagatgtacataaatgacccttaatttggcacgttttcacatttaattttttaaaatacagcttttcatatacagttcctaaaaaaaaaaaaaaaaaaaactcgagactagttctctccatttaatgactttccctgctgttacctaattacaaatntggatggaactgngttttttttctgcttttgttttttcaggtttgctgttttctgtagcccataattggatttcttgtgtcaaaataaagtccct

SEQ ID NO: 89272 - DNA, 217 bp, Homo sapiens
gttcttctgaaccaaagaaaacaggcaactgaaattctgtccataggccagaagtgcagaaggaaactaggcatttatgagaagggtcctggagtccaggttaatgacttaaggcagggcagcctgtggcctgctctgttagctctggcaaaggtcattattgaaaagtggttttgtttcttctgagtaaacgtaaaaacagagaggaagggcgtct

SEQ ID NO: 89273 - DNA, 1642 bp, Homo sapiens
ggagatcagcaccaaatccacagaggcatctgagaagtcagctggggagactctgtgaaagtaatgaaggtcatcaatgcggagagaccttgagccagactgcgaaccttcttgtgcacaagagttaccctaccgaagctaaaccctctgagtgcactaagtgtggcaaagccttcgagaatcggcagagatctcacactggacagagaccgtgtaaggaatgtgggcaagcctgcagctgcctctcctgccaaagccctcctatgaaaacgcagactgtagagaaaccctgtaattgccaggactcaaggacagcatctgtgacatacgtgaaaagtctcagcagtaaaaagtcttatgaatgtcagaaatgtggaaaagctttcatttgtccctcatctttcaggggacatgtgaatagtcatcatgggcagaaaacccatgcatgtaaagtatgtgggaagacctttatgtattactcctaccttacacggcacgtaagaactcacacaggagagaaaccctatgagtgtaaggagtgtgggaaagccttcagctgtccctcgtactttcgagaacatgtcagaacacacactggagagaaaccgtatgaatgtaagcattgtggaaaatcattcagctgttactcctcctttagagatcacgtgaggacgcacactggagagaaaccctgtcagtgtaaacattgcggaaaagcgttcacttgttactcgtctcttcgagaacatgggagaacgcacagtggagagaaaccctatgaatgtaaggaatgcggcaaagccttcaggtacccctcctctctgcgagcacacatgagaatgcacaccggagagaagccctatgtgtgcaagcagtgtgggaaggccttcggatgtcccacttactttagaagacatgtgaaaacacacagcggggtgaagccctatcaatgtaaagagtgtgggaaagcctacagtttttcctcctcccttcgaatccacgtgaggacgcatactggagagaagccctttgagtgtaagcattgtgggaaagccttcagctgtcactcctcccttcgagagcatgtgcgaacccacagcggagagaaaccgtacgaatgtaatcaatgtgggaaagccttcagccacgctcagtactttcaaaagcatgtgagatcacacagtggggtcaaaccctacgaatgtactgaatgtgggaaagcctacagttgttcctcgtcccttcgtgtgcacgtgagaacgcacactggagagagaccgtatgaatgcaagcagtgtgggaaaaccttcaggtatctcgcatcgcttcaagcacatgtgagaacacatgctggagcgtgaatctacaaatacagtggacctgggagagtgttcaaccgtaaaaccttgttgtaaatgtgagaaacgttatttatgtagagcatgtaggaaaacctggtatagcacttattttgtacctaaaaattcagagtaggagagaaatctcttaattatgattaatatggtattgcctttacatgcctcagccttaatagtgattccttttgtattaatttctagtgtatgtttgtgatataaacatttaataaatatcctgttttgtacgctttcaaaaaaaaata

SEQ ID NO: 89274 - DNA, 1587 bp, Homo sapiens
ggagatcagcaccaaatccacagaggcatctgagaagtcagctggggagactctgtgaaagtaatgaaggtcatcaatgcggagagaccttgagccagactgcgaaccttcttgtgcacaagagttaccctaccgaagctaaaccctctgagtgcactaagtgtggcaaagccttcgagaatcggcagagatctcacactggacagagaccgtgtaaggaatgtgggcaagcctgcagctgcctctcctgccaaagccctcctatgaaaacgcagactgtagagaaaccctgtaattgccaggactcaaggacagcatctgtgacatacgtgaaaagtctcagcagtaaaaagtcttatgaatgtcagaaatgtggaaaagctttcatttgtccctcatctttcaggggacatgtgaatagtcatcatgggcagaaaacccatgcatgtaaagtatgtgggaagacctttatgtattactcctaccttacacggcacgtaagaactcacacaggagagaaaccctatgagtgtaaggagtgtgggaaagccttcagctgtccctcgtactttcgagaacatgtcagaacacacactggagagaaaccgtatgaatgtaagcattgtggaaaatcattcagctgttactcctcctttagagatcacgtgaggacgcacactggagagaaaccctgtcagtgtaaacattgcggaaaagcgttcacttgttactcgtctcttcgagaacatgggagaacgcacagtggagagaaaccctatgaatgtaaggaatgcggcaaagccttcaggtacccctcctctctgcgagcacacatgagaatgcacaccggagagaagccctatgtgtgcaagcagtgtgggaaggccttcggatgtcccacttactttagaagacatgtgatttttcctcctcccttcgaatccacgtgaggacgcatactggagagaagccctttgagtgtaagcattgtgggaaagccttcagctgtcactcctcccttcgagagcatgtgcgaacccacagcggagagaaaccgtacgaatgtaatcaatgtgggaaagccttcagccacgctcagtactttcaaaagcatgtgagatcacacagtggggtcaaaccctacgaatgtactgaatgtgggaaagcctacagttgttcctcgtcccttcgtgtgcacgtgagaacgcacactggagagagaccgtatgaatgcaagcagtgtgggaaaaccttcaggtatctcgcatcgcttcaagcacatgtgagaacacatgctggagcgtgaatctacaaatacagtggacctgggagagtgttcaaccgtaaaaccttgttgtaaatgtgagaaacgttatttatgtagagcatgtaggaaaacctggtatagcacttattttgtacctaaaaattcagagtaggagagaaatctcttaattatgattaatatggtattgcctttacatgcctcagccttaatagtgattccttttgtattaatttctagtgtatgtttgtgatataaacatttaataaatatcctgttttgtacgctttcaaaaaaaaata

SEQ ID NO: 89275 - DNA, 689 bp, Homo sapiens
agccgggatacgggtggggaaggggggctcgcgccctacaggccgagccctgcggccgcggcggggtaagggtaggatggccgatcgcgcccagaccccagggagtctccctctcggcttttctgccggcgtctccagcagcatgatctggcatttattattcggaataatgtgccaggcaggaggaggccctgggttaaacacgcggccctgcagctcccaggtgaaacgactcatcgtttcctgccggcgcatcttactgaaggggacccaggccccacgaagggaaggaaccgtcctcaaggtcacgtcgtagtcaaaggccgagcccagaccgaagccagccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctggtcagtgtccttctttctacaagaggcgttggagccgggctctgcatagggcgtatatatccctggccgccaaggaagctgacccttgaaatttttgaagctttcatattcactcaatacacatttacagagcctctacttcctgtcaggcgtcacacaataaatattcggaggagcaagaagagagtgattc

SEQ ID NO: 89276 - DNA, 470 bp, Homo sapiens
ggctcgccaagcatgtcacggttctcaatcttgtcaccttgccaaggtccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatgtcttctaacatttataatataatatggaaccttccctccaaattcttcaataaa

SEQ ID NO: 89277 - DNA, 1663 bp, Homo sapiens
ggaggaggcggctcggcggccccccgacagccacgccgccgtgagccccgcccagcgtagccccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctta

SEQ ID NO: 89278 - DNA, 1948 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgatattggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatg

SEQ ID NO: 89279 - DNA, 2401 bp, Homo sapiens
tcaagaaatagccaaaaaaaaaaaaaaaaaaaaaaggcacccaccacccctcagggctgttctgcctatggggtacccattttaaaaaatcatttactttcctgagtctccagcctcttcttggaaatggccctatctaaaaaccacttggccattttgaaatctttctcaggtcctgattctgggttatgctcagggcagtctctgaagatttctcatcctgttcaggccggttccttgctaatttatgcccacacatacctggcagggagagctaaagatggagttggtgggagctgccctttggcatcattgatttttaatgtattcctaagcagcagcatctgtccttgatcctctgcttgtcagaaggccaaactcacagacattttaagcttaaaacaaacagttacaaagctgttgaactttgcctgtgcaaggacaaacacaaaaacatcccaaggcccaccccccgccgacccccactgtacttgtcacacatatgtgagaatttccattctcagctaaaggcaagcattgaaagaatacacagaaagcctggaaaaggtttccaggggtgtcaatacgccctgtcaactgagaattaagaggatccggctggtcacttgcctggagaggatcctgcatgctgatagtgctgaggcacctgccagctaagaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgatattggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatg

SEQ ID NO: 89280 - DNA, 2034 bp, Homo sapiens
tcaagaaatagccaaaaaaaaaaaaaaaaaaaaaaggcacccaccacccctcagggctgttctgcctatggggtacccattttaaaaaatcatttactttcctgagtctccagcctcttcttggaaatggccctatctaaaaaccacttggccattttgaaatctttctcaggtcctgattctgggttatgctcagggcagtctctgaagatttctcatcctgttcaggccggttccttgctaatttatgcccacacatacctggcagggagagctaaagatggagttggtgggagctgccctttggcatcattgatttttaatgtattcctaagcagcagcatctgtccttgatcctctgcttgtcagaaggccaaactcacagacattttaagcttaaaacaaacagttacaaagctgttgaactttgcctgtgcaaggacaaacacaaaaacatcccaaggcccaccccccgccgacccccactgtacttgtcacacatatgtgagaatttccattctcagctaaaggcaagcattgaaagaatacacagaaagcctggaaaaggtttccaggggtgtcaatacgccctgtcaactgagaattaagaggatccggctggtcacttgcctggagaggatcctgcatgctgatagtgctgaggcacctgccagctaagaaccaccgggaggaactgggccattctaacacccgttgctaccatgctggccacccgcctctccagacccctgtcacggctcccaggaaaaaccctaagtgcctgtgatagagaaaatggagcaagggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctta

SEQ ID NO: 89281 - DNA, 1732 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggtgagtgggaaagggagctccctcctgcccctgaacctgccccacgtgttcatctttgctcagaatggaaatacctgtcccagcagctccaatgtccacaactcagcagaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctta

SEQ ID NO: 89282 - DNA, 1875 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacaagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgatattggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatg

SEQ ID NO: 89283 - DNA, 1090 bp, Homo sapiens
  misc_feature (55)..(55): n is a, c, g, or t
  misc_feature (68)..(69): n is a, c, g, or t
gcgagggttgagaagtgtctggtcacaggtgtatctggattgggtctcatggcangattgattcaaanngttcttgtgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctta

SEQ ID NO: 89284 - DNA, 1111 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgatattggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatg

SEQ ID NO: 89285 - DNA, 784 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctctccggagataatttcatacagagattttaagaaaacatctttatattaaaaacagatctcatttgatcctta

SEQ ID NO: 89286 - DNA, 802 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctgaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaagctttgaagcacccactgagtgggcggatcataatttacttcatcaaaatctcctgtaaatgagcatttaggtgttttcaatattttgcaattacaaataatgccacaatgaata

SEQ ID NO: 89287 - DNA, 1427 bp, Homo sapiens
tcaagaaatagccaaaaaaaaaaaaaaaaaaaaaaggcacccaccacccctcagggctgttctgcctatggggtacccattttaaaaaatcatttactttcctgagtctccagcctcttcttggaaatggccctatctaaaaaccacttggccattttgaaatctttctcaggtcctgattctgggttatgctcagggcagtctctgaagatttctcatcctgttcaggccggttccttgctaatttatgcccacacatacctggcagggagagctaaagatggagttggtgggagctgccctttggcatcattgatttttaatgtattcctaagcagcagcatctgtccttgatcctctgcttgtcagaaggccaaactcacagacattttaagcttaaaacaaacagttacaaagctgttgaactttgcctgtgcaaggacaaacacaaaaacatcccaaggcccaccccccgccgacccccactgtacttgtcacacatatgtgagaatttccattctcagctaaaggcaagcattgaaagaatacacagaaagcctggaaaaggtttccaggggtgtcaatacgccctgtcaactgagaattaagaggatccggctggtcacttgcctggagaggatcctgcatgctgatagtgctgaggcacctgccagctaagatgaagtcttgctgtcacccaggctagagtgcagtggcaagatctcagctcactgcaacctccgcttcctgggttcaagcaattctcctgcctcagctttccaagtagctgtgattacagtagcctaccaccacgcctggctaatttttgtatttttagtagagatgggattttaccatgttgaccaggctggtctcaaactcctgacctcaagtgatctgcctgcctcagcctcccaaagtgctgggattacaagtgtgagccactgctcccagccataactttctttacatctcttttattttcctggttccttttatattgttttaaacatgacctttaaataagctttgaattagacaaaaactattcatctttttaaaaatgacacactttttaaaaagaatgttttcttacaaatatatttttattggaaaatacccatataatgaaatatctattacttaatttaatataactttagattctaaattatgagtttgtctacaagtattacattcacctaattattttaattgttttagatgatttatgaaaactgtgatagtcatcatttaaagttatggaaccatcattgcaaaattataacagagacgtgaaaaagatttgcctaactgactccatcttgcttttaacctccaaactctccttgttcattcttcttttctctcctaggaaattgttgtttaaggatcctaattctagttcagagatgcattctaaaggg

SEQ ID NO: 89288 - DNA, 615 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagagcaacactgggggtcatgggaatacagactgatgctctttggatggagtcattcacaagctttgggtgtaccgaccacactatcctgatcacttgagaccatccgtgcacaaggacttaaaatccagactcctctgtggcagtacaaaaggacagggggttaccttggcaggttttcctagtgaaccctcatttctgtctagtgaatttaatgttctttaagaacatattttaataattttttaaaagcttaatatgttgaa

SEQ ID NO: 89289 - DNA, 366 bp, Homo sapiens
aaagctcagatccacacagacagctgtctcgcctcccacttctcccctcgtgttttcaccccaaattatcaccgcatcgggcttgatctggtttttgagtcagttgcgtgttgcccattacactgtgccctgctgcttctcactcacttgtcctcccctgtcctgcctggcacagccaggttcccagggaagaccaggggtgccgatgctgatgcgtgggcctgagctggccttgcctattgactgagaaggctcctgggtggctcagaagtggttccagccaagcctctagagacatgccagacttctgcccgctgtgtcatagggcagtaacggcttagcaggtacctctgtctccctctgtag

SEQ ID NO: 89290 - DNA, 344 bp, Homo sapiens
ccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgat

SEQ ID NO: 89291 - DNA, 450 bp, Homo sapiens
ttatcccaagacaagccattggttggggccccggcaaggatccaatacccggggccccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccagtagtagtccatggggtggtagcgggtgtaggggggtcgacgcggccgcgaatttagtagtagtaggcggccgctctaga

SEQ ID NO: 89292 - DNA, 1621 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctta

SEQ ID NO: 89293 - DNA, 2100 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctgaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgatattggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatg

SEQ ID NO: 89294 - DNA, 1647 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctgacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctta

SEQ ID NO: 89295 - DNA, 1448 bp, Homo sapiens
ggctactcaggaggctgaggcaggagaatcgcttgaacccaggaggcggaggttgcagtgagctgagatcgtgtcactgcactccagcctgggcaacaagagtgaaactctgtctcaaaaacaaaacaaaacaaaacaaaaaacaaaatttgaatggcgtcaaatggtatacagaaaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctta

SEQ ID NO: 89296 - DNA, 1274 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccagtagtagtccatggggtggtagcgggtgtaggggggtcgacgcggccgcgaatttagtagtagtaggcggccgctctaga

SEQ ID NO: 89297 - DNA, 1448 bp, Homo sapiens
gcatgatccggctcattgcaacctctgcctcctgggttcaagagattttcctgcctcagcctcccgagtagctgggactacaggtgcccgccaccacacccggctaatctttgtattacaggatagagttcttggaagcctggcgtggagggagggagagcaggtagcacagttacagaaggatcttcgggatatggaaatgcggtatttgtggacactcattcatctaacacacatttgttgagctcctaatgtgtatagaactgaagggatggagtcatgggcagtggaaaagctgaaattgtgtaaaagagagagaaggatcagtggctatggtctcgaagatgacgtggaagtgtcagccatgacgggtggggagtggcctgctgctcctcctgggaagagaagaaggtgaagactcagggcgcgtctgcagggagacagtgggagctgtggggtcgtggatgacgctgatcctgtcattagcatctgagcgaggtcacaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatcctta

SEQ ID NO: 89298 - DNA, 1229 bp, Homo sapiens
ggaggaggcggctcggcggccccccgacagccacgccgccgtgagccccgcccagcgtagccccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgatattggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatg

SEQ ID NO: 89299 - DNA, 886 bp, Homo sapiens
  misc_feature (542)..(542): n is a, c, g, or t
  misc_feature (585)..(585): n is a, c, g, or t
  misc_feature (612)..(612): n is a, c, g, or t
  misc_feature (698)..(698): n is a, c, g, or t
  misc_feature (731)..(731): n is a, c, g, or t
  misc_feature (733)..(733): n is a, c, g, or t
  misc_feature (794)..(794): n is a, c, g, or t
  misc_feature (798)..(798): n is a, c, g, or t
  misc_feature (815)..(815): n is a, c, g, or t
  misc_feature (883)..(883): n is a, c, g, or t
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaagacaaangcaatgatgggtcaagagctgacagctaacagtacgattagancgtcagctcatgtctgagcagcgaaangtgagaatgtgaatgtcgctcagctaagacctataagatgtgggctcgtacatgcgcattacgtcggagtgagtcacagctgaacncacagtgaaatacttggacagtcgatacgaacntntccctatcgagcaagcgcgtgtaaatacacatctggcgatgcaaccgcctcctatatacantggnagtttgatctcataatncctggtagtactgtgacgaatatctcacacttaactaacatagcatcaaaattgagatctagtatcanata

SEQ ID NO: 89300 - DNA, 600 bp, Homo sapiens
ggctggtacggtcggagattttggatcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagaggtaagcaaccagaggtggtggtggccttgaggggacactttctgagcaggcagaggttttcacacatggacagtgtaggcggtgatgaggcctgattctcagagatgtctctcaatacctttgtctcccagcagaggaaactcagaggtgtcctgggaagacattttcccagggcacacagggcagaaaggaatatctttcataaccacttatttttttttctttttgatggagtctcactctgtt

SEQ ID NO: 89301 - DNA, 368 bp, Homo sapiens
taatggaaagaacccttgtcttcgcaacatctagattaagaaatggaatattacaaatagaaatatggccaccttcatgtttctctttgatctgattttcctcctttcagtctcagagttaatctaatcttaaattcagtctctcttaattatgtatatatatatagatagatatagatatatatactttttaacattttcatgggtctcaagtctatacatagtattgtttttcatttataaaacatcataaactgataacatactgtatgtattcctctgttcctctctttctggctggaccctgtgtgtgaagtttatggagatagcacattttttctgtgctgtgcattgttccatcatgtgaa

SEQ ID NO: 89302 - DNA, 319 bp, Homo sapiens
tactgaccgcggtccctcacctgctgactgattgacttataaatctgccccccacccacttgtctgtccattgaaggcaaattcgccatcgggaacacagtagtttctcaataactatctaatgcatggccacccttcccaggatttagaatatcaaagggacgtgttctttcctcccaaatcacctgcctgcgcttcccccagccgggtgccccagccttcacctcggtccggccaccacctcatcccgcttcttcgcggcttccaggcctcgggctggggatctcagcccctgcctgtaggtgcggcccagagggtg

SEQ ID NO: 89303 - DNA, 677 bp, Homo sapiens
ttccctcaagcatttatcctttgtgttataaacaatccattgacactcttagttattttaaaatgtacaattacgttattattgactatagtcaccctgttgtgctttcaaatagtaggtcttattcattcattctattttttttgtactcattaactatccccatctcccctccaaccccccactacccttcacagtctgtgatagccattcttctattctctattgacactgtttttaatgagccagaggcagtgaactttctcaagtgtgtaacaggaggctttcttagggacagttgctggtgcagttaaactgcctagttgaggtgtgccttgcctcgcacaatagattaatgcatccccaagttggataatatcgtcatgcatgaaagcagcctgctagtctaagggagtcctatagcaaaccatctttataaagtgaacagtgacacccaatttataaatctaaatttttgccattttcttaaaatgaaatatagtttcaaactggggtactaatgtctgaaaaggttttatgcctctacagttaatttaccctgagacagtaatttctagtaactctagtcatttctaaatagtctgagtcagttttcctagaatttaggacaggactcaaaaaaatacagttcaagctctttccccatgtttcaggga

SEQ ID NO: 89304 - DNA, 525 bp, Homo sapiens
gcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagacta

SEQ ID NO: 89305 - DNA, 481 bp, Homo sapiens
gagaagacaaagactagggtgaccatgagaaggaggtgaagtggggtagaggaagattggaactcagcaggtcaaggatttgaggccaggaacatacatgggtttcagggaaagaaaatgggaatagggatggaaagagaagtctgtgaggtgaaccatctttagtgagtgaggaggttgatagcagatggcagcagtaaggaaggtaggaagttggtacaacttcatgaatgagtttcagagtagtaggagattttgcaagaaggagaagtggtttggaaggggccttaggtggggaggcaagcaaaaaatccagtcacctcctgacttgggtatgtggagtgtaaagtgtaggggagggggagcccttaggatatttctgttaaggaaggagttgatgttccaagaacacattaaagatacagaaacggttcctgatccaaagcaaacttccagcagttactgtgaaagggatggggag

SEQ ID NO: 89306 - DNA, 313 bp, Homo sapiens
atagatgttggaaagcaaagatccttttgtgagctcaagtaattggaatgcattctatgaacatttttttaaaaacaaaaaaaagaataacatcatgcgttcattttaatgggaataaagatggctgcctctacaacatatttaggttcccaaagtgaaaatacatttggttagatgattggcttttggcttgcacttttctggttgaggtttactggattatttaaaaatttagaacaaactgttttgaatgttatgtatgaatttaacacaattagatgagtagaatatagactcaaaaaactaacttatt

SEQ ID NO: 89307 - DNA, 389 bp, Homo sapiens
tcccagcattttgagacatcaaagcagaaagattgctcaagaccaggagttcaagaccagcctgggcaacatagcaagatcccttctcagtaaaaaaattagccagactagctggcattgtgggtaggcaccactgtgcccagctcctgttttataataaataagccagagctctatctccaaatggtgcaaatcatcaatgctattaaaacaagaatggaaaagcttcaggtggtaatggtgattttttcatcctccctaccccctcccatcccaatgtgtgtgtgtgtgtgtgtgtgtgtgtgtgtgtgtgtgtgtgtataattttttttttttttttaagacagcctcgctctgtcgcccaggctggagtacagtggctcgatctt

SEQ ID NO: 89308 - DNA, 226 bp, Homo sapiens
tcccagcattttgagacatcaaagcagaaagattgctcaagaccaggagttcaagaccagcctgggcaacatagcaagatcccttctcagtaaaaaaattagccagactagctggcattgtgggtaggcaccactgtgcccagctcctgttttataataaataagccagagctctatctccaaatggtgcaaatcatcaatgctattaaaacaagaatggaaaagc

SEQ ID NO: 89309 - DNA, 1443 bp, Homo sapiens
ccaaagtgctgggattacaggcatgagccaccacacccggcctgtcttccttttttcaatacatcagtcttacggcaaagacagccctcccaggattgcccaaagtccctcctgcatttacctctctacctcggttaataagtagagtggctcaccactggagggtgacatgctgctgcagaatcaccatgttatgcctgtggctcttctgaatatcttatcattttcctgtttaagagagttcccacacttcaagacaatattggtattttaacatagtagcattgattaatatatttgtctcccgatgaatcacccagacactttgatttggccactgcatatctctgaacaggaaagcctatacaggtcgagtgtgattggaggctgaggctcagccctagacacctattaatgcgtgaactagtcttcaagggcagacctggttataaagcttctagatcatcggagtttgaggtactccaagaaaatgagggtggtgttatttagaggaagctgaatgttaactctttgtaatataaattaccacatataagttgtatacacactctccatctaaattataaaattagctttttgtatatattttcacaaatcaaaggttacaggtaatgatgttcttctcaaacttcaaaagtgtgtgtgtgttttaatacagttcatttgaagggctcagagaatatctactcttcacagcgtcctatataaaatagtttctgtaatcagatcaacagtgataacttgttttattccagtgtaaaattaaacaagtgggaaaatatctccacagaaaccagaaagacacaattacatagtttgaaggaggcaattagaatccagcaaaccagtgggtttgttaaaagcctatttcttgactgtcagcctgttctcttgaaactacaatatatgttgctttaaggtatctttaaacaagtaactattttctcttagctggtagtggatgataattccattttagaaatacttctctacaactatcctctctcaactctgaggctcctagataaacaataattttatccatgtcaaaaataaactaagaaacaatccgaataaattataataaatacctttactagttgtaaaattttaatacctcaggaaataccacagtgttcccactaatgctattttttaattttttaatttagtttgtcataatttggtttcatcaactcctttgttttttccttctttttttttttttgagatgaggtctcactatcttgcccagactggtttcgaattgccctccagcaattctcccacctcagccttcagagtagctggcattgtgggtaggcaccactgtgcccagctcctgttttataataaataagccagagctctatctccaaatggtgcaaatcatcaatgctattaaaacaagaatggaaaagc

SEQ ID NO: 89310 - DNA, 1606 bp, Homo sapiens
ccaaagtgctgggattacaggcatgagccaccacacccggcctgtcttccttttttcaatacatcagtcttacggcaaagacagccctcccaggattgcccaaagtccctcctgcatttacctctctacctcggttaataagtagagtggctcaccactggagggtgacatgctgctgcagaatcaccatgttatgcctgtggctcttctgaatatcttatcattttcctgtttaagagagttcccacacttcaagacaatattggtattttaacatagtagcattgattaatatatttgtctcccgatgaatcacccagacactttgatttggccactgcatatctctgaacaggaaagcctatacaggtcgagtgtgattggaggctgaggctcagccctagacacctattaatgcgtgaactagtcttcaagggcagacctggttataaagcttctagatcatcggagtttgaggtactccaagaaaatgagggtggtgttatttagaggaagctgaatgttaactctttgtaatataaattaccacatataagttgtatacacactctccatctaaattataaaattagctttttgtatatattttcacaaatcaaaggttacaggtaatgatgttcttctcaaacttcaaaagtgtgtgtgtgttttaatacagttcatttgaagggctcagagaatatctactcttcacagcgtcctatataaaatagtttctgtaatcagatcaacagtgataacttgttttattccagtgtaaaattaaacaagtgggaaaatatctccacagaaaccagaaagacacaattacatagtttgaaggaggcaattagaatccagcaaaccagtgggtttgttaaaagcctatttcttgactgtcagcctgttctcttgaaactacaatatatgttgctttaaggtatctttaaacaagtaactattttctcttagctggtagtggatgataattccattttagaaatacttctctacaactatcctctctcaactctgaggctcctagataaacaataattttatccatgtcaaaaataaactaagaaacaatccgaataaattataataaatacctttactagttgtaaaattttaatacctcaggaaataccacagtgttcccactaatgctattttttaattttttaatttagtttgtcataatttggtttcatcaactcctttgttttttccttctttttttttttttgagatgaggtctcactatcttgcccagactggtttcgaattgccctccagcaattctcccacctcagccttcagagtagctggcattgtgggtaggcaccactgtgcccagctcctgttttataataaataagccagagctctatctccaaatggtgcaaatcatcaatgctattaaaacaagaatggaaaagcttcaggtggtaatggtgattttttcatcctccctaccccctcccatcccaatgtgtgtgtgtgtgtgtgtgtgtgtgtgtgtgtgtgtgtgtgtataattttttttttttttttaagacagcctcgctctgtcgcccaggctggagtacagtggctcgatctt

SEQ ID NO: 89311 - DNA, 1098 bp, Homo sapiens
ccaaagtgctgggattacaggcatgagccaccacacccggcctgtcttccttttttcaatacatcagtcttacggcaaagacagccctcccaggattgcccaaagtccctcctgcatttacctctctacctcggttaataagtagagtggctcaccactggagggtgacatgctgctgcagaatcaccatgttatgcctgtggctcttctgaatatcttatcattttcctgtttaagagagttcccacacttcaagacaatattggtattttaacatagtagcattgattaatatatttgtctcccgatgaatcacccagacactttgatttggccactgcatatctctgaacaggaaagcctatacaggtcgagtgtgattggaggctgaggctcagccctagacacctattaatgcgtgaactagtcttcaagggcagacctggttataaagcttctagatcatcggagtttgaggtactccaagaaaatgagggtggtgttatttagaggaagctgaatgttaactctttgtaatataaattaccacatataagttgtatacacactctccatctaaattataaaattagctttttgtatatattttcacaaatcaaaggttacaggtaatgatgttcttctcaaacttcaaaagtgtgtgtgtgttttaatacagttcatttgaagggctcagagaatatctactcttcacagcgtcctatataaaatagtttctgtaatcagatcaacagtgataacttgttttattccagtgtaaaattaaacaagtgggaaaatatctccacagaaaccagaaagacacaattacatagtttgaaggaggcaattagaatccagcaaaccagtgggtttgttaaaagcctatttcttgactgtcagcctgttctcttgaaactacaatatatgttgctttaaggtatctttaaacaagtaactattttctcttagctggtagtggatgataattccattttagaaatacttctctacaactatcctctctcaactctgaggctcctagataaacaataattttatccatgtcaaaaatctcgtgccgaattcctacagccc

SEQ ID NO: 89312 - DNA, 1301 bp, Homo sapiens
ccaaagtgctgggattacaggcatgagccaccacacccggcctgtcttccttttttcaatacatcagtcttacggcaaagacagccctcccaggattgcccaaagtccctcctgcatttacctctctacctcggttaataagtagagtggctcaccactggagggtgacatgctgctgcagaatcaccatgttatgcctgtggctcttctgaatatcttatcattttcctgtttaagagagttcccacacttcaagacaatattggtattttaacatagtagcattgattaatatatttgtctcccgatgaatcacccagacactttgatttggccactgcatatctctgaacaggaaagcctatacaggtcgagtgtgattggaggctgaggctcagccctagacacctattaatgcgtgaactagtcttcaagggcagacctggttataaagcttctagatcatcggagtttgaggtactccaagaaaatgagggtggtgttatttagaggaagctgaatgttaactctttgtaatataaattaccacatataagttgtatacacactctccatctaaattataaaatagtttctgtaatcagatcaacagtgataacttgttttattccagtgtaaaattaaacaagtgggaaaatatctccacagaaaccagaaagacacaattacatagtttgaaggaggcaattagaatccagcaaaccagtgggtttgttaaaagcctatttcttgactgtcagcctgttctcttgaaactacaatatatgttgctttaaggtatctttaaacaagtaactattttctcttagctggtagtggatgataattccattttagaaatacttctctacaactatcctctctcaactctgaggctcctagataaacaataattttatccatgtcaaaaataaactaagaaacaatccgaataaattataataaatacctttactagttgtaaaattttaatacctcaggaaataccacagtgttcccactaatgctattttttaattttttaatttagtttgtcataatttggtttcatcaactcctttgttttttccttctttttttttttttgagatgaggtctcactatcttgcccagactggtttcgaattgccctccagcaattctcccacctcagccttcagagtagctggcattgtgggtaggcaccactgtgcccagctcctgttttataataaataagccagagctctatctccaaatggtgcaaatcatcaatgctattaaaacaagaatggaaaagc

SEQ ID NO: 89313 - DNA, 1389 bp, Homo sapiens
ccaaagtgctgggattacaggcatgagccaccacacccggcctgtcttccttttttcaatacatcagtcttacggcaaagacagccctcccaggattgcccaaagtccctcctgcatttacctctctacctcggttaataagtagagtggctcaccactggagggtgacatgctgctgcagaatcaccatgttatgcctgtggctcttctgaatatcttatcattttcctgtttaagagagttcccacacttcaagacaatattggtattttaacatagtagcattgattaatatatttgtctcccgatgaatcacccagacactttgatttggccactgcatatctctgaacaggaaagcctatacaggtcgagtgtgattggaggctgaggctcagccctagacacctattaatgcgtgaactagtcttcaagggcagacctggttataaagcttctagatcatcggagtttgaggtactccaagaaaatgagggtggtgttatttagaggaagctgaatgttaactctttgtaatataaattaccacatataagttgtatacacactctccatctaaattataaaattagctttttgtatatattttcacaaatcaaaggttacaggtaatgatgttcttctcaaacttcaaaagtgtgtgtgtgttttaatacagttcatttgaagggctcagagaatatctactcttcacagcgtcctatataaaatagtttctgtaatcagatcaacagtgataacttgttttattccagtgtaaaattaaacaagtgggaaaatatctccacagaaaccagaaagacacaattacatagtttgaaggaggcaattagaatccagcaaaccagtgggtttgttaaaagcctatttcttgactgtcagcctgttctctcttagctggtagtggatgataattccattttagaaatacttctctacaactatcctctctcaactctgaggctcctagataaacaataattttatccatgtcaaaaataaactaagaaacaatccgaataaattataataaatacctttactagttgtaaaattttaatacctcaggaaataccacagtgttcccactaatgctattttttaattttttaatttagtttgtcataatttggtttcatcaactcctttgttttttccttctttttttttttttgagatgaggtctcactatcttgcccagactggtttcgaattgccctccagcaattctcccacctcagccttcagagtagctggcattgtgggtaggcaccactgtgcccagctcctgttttataataaataagccagagctctatctccaaatggtgcaaatcatcaatgctattaaaacaagaatggaaaagc

SEQ ID NO: 89314 - DNA, 4212 bp, Homo sapiens
  misc_feature (65)..(65): n is a, c, g, or t
  misc_feature (796)..(796): n is a, c, g, or t
  misc_feature (1033)..(1033): n is a, c, g, or t
agaatttagctttttcaggaactgccatactggcttttcttttgtttttttgttttgagacagantctcactttgttgcccaggctggagtgcagtggcactctctcaggtcactgcaacctctgcctccgcagttcaagtgattctcatgcctcagcctcccaagtagctggaattacaagtgtgcaccaccacacctgtttttgtatttttttttttttatgagacggagtttcgctctcgttgcccaggctgaagtgcagtggtacaatctaggctcaccacaacctccacctcccaggttcaagcgattctcctgcctcagcctccccagtagctgggattacaggcatgcgccaccacacccggctactgtttttgtatttttaatagagatggatttttgccatgttggccagggtggtgttgaactcatgacctctagtgatccacctacttccgcttcccaaagtgctgggattacagacgtgagccactgtgctcagccccatactgggttttgtatcagcatgtatattttccattcccaccagcagtgcagactgttgcaatttctccacatccttggcaacacttactattttttattatggcctttctaatatgtgtgaagtggtatctcattgcggttttgatatgcattcccctaatgaccaatgacatcgagcatccattcctgtgtttattgaccatttgtgtatcgatttttgggggaaatgtaagatctgtaattttttttttttttttactctgtcgcccatgctggaatgcagtnctgcaatctcggctcactgcaagccctgcctcccgagttcatgtcattctcccgcctcagcctcccaagtagctgggactacaggcgcctgccaccacacccggctaattttttgtatttttagtagagacggggtttcaccgtgttagccaggatggtcttgatctcctgacctcatgatccacccgccctgccctcccaaagtgatgggattacaggtgtgagccactgcacccncccttttttttttttttttttttgagacagagtctcactctcattgcccagcctggggtgcagtggtgtgatcacagctcactgcagccttgacctccccagggctcaagtgatcttcccacctcaatctcccaggtagctgggactataggcttagaccaccacacctggctagtttttttgtttgtttgtttttggtttttttttggtaggtccggggtcttgtcatgttgctcaggctggtctcaaactcctgtgttccagtgatcacctgcctctgggcctcccaaagtgttgggattacaggtgtgagccaccacgcccaaccagatctgtaattttttttttctttgagactgagtcttgctctgttgcccaggctggagtgcaatgccacgacctcggctcactgcaacctctgcctcctgggttcaagtgattctcccacctcagcctcctgagtaactggggttacaggcatgcaccaccacgcccagctaatttttgtatttttagtagagatggggttttaccatgttggccaggctggtctcaaactcctgacctcaggtgatccgcctgcctcggcctcccaaattgctgggattacaggagtgagccaccatgcctggcacagatctgtaattttttaactagaaaataaaatcattatcttgtgctacctctcaagtatactcttgtctttttcagaagccttgaagaaccaatgtactgatgtggggattaaagagggtccactttccccagcacaaacctcacaagtcactagtctttcctcatggacggggtatttactttttcaaccagtggcttcttcccacttggagcaaagagaagccctgtggatagaggaaaaaggaactcctcaagcctcctgttcagattggatgactgtactaagaaaccaagactcaacttacaagaaggtggctttgcaggaggaaccagccagtggtataaatatgataaagcttatcagagaagatgggggatggaagcagttagaggacagccatgaagacccccaggggcttttgagccaaaaggcatcccttcacgtagtggccgttcctcaggagaaggctactgcatggcatggatttggggaaaatggtaatctgagcccagcccttgttttatcacagggaagctctaaagggaaccacttgtgtggcagcgagttagatattacaagcttggcatccgattcagtcttaaaccaccatcagctgggatatgcagatcggagaccttgtgaaagtaatgaatgtggaaatgccatccgccagaacagtcactttattcaacacggggggaagatgtttgtgtatttggaaaatgggcagtcattgaaccacggtatggccctgactatccacaacaaaatcaacacggcagagaaaccctttgagtgccaccagtgtgggaaggtgttcaaccggaggcattctttgagcgaacatcaaagaattcacacgggggagaaaccctacgagtgtcaggagtgtgggcgagcctttacgcacagctccaccctcacgcgccatctgagaactcatactggagagaagccctacgggtgcggtgagtgcgggaaagccttcaacaggatctcatcgctgactcagcatcagaggattcacaccggggaaaagccctataaatgtgaagactgtgggaaatccttctgccagagctcttacctgatcttgcacaagaggacacacaccggagagaagccctacgaatgcagtgaatgtggaaaggccttcagtgaccgttcctctctcaaccagcacgagcgaactcacacgggcgagaacccctatgaatgtaagcagtgtgggagagccttcagccagaggtcttcccttgtgaggcacgagagaactcacactggagagaaaccctacaggtgtcaggaatgtgggaaagccttcagccagagctcatcccttgtcacacatcagaaaactcacagcagccagaaaacctataaaatcattgactgcgggaaagcgttctaccagaacagacatcttattggatattagcaattgcacgctgctttgtaagccactttttagtactctgacacatacatgtggttatcttttgccctgttgtgatggataatttgaaaagaagtgggtttatgtcaccttctcaccttcttataagaaagctctgagaatgggcatttttgtattttgttgttgttgttgagatggagtctgccacccaggctggagtccagtggcgtgatcatacctcactgcagcttcaacttcctgggctcaagtaatcctcccaccccagcctcccaggtagctagtactataggtgtgcaccaccacgcccagcaaatttttaaatttattatagagtgggaggcagggtgcggtggctcatgcctataatcctaacactttaggaggccgaggcgggtggatcatgaggtcaggagatcgagaccatcctggctaacacagtgaaaccctgtctctactaaaaatacaaaaaagtagccgggcgtggtggtgggcgcctgtagtcccaactactcaggaggctgaggcaggagaatggtgtgaacccgggaggtggagcttgcagtgagccaagatcgcaccactgcactccagcctgggagacagagcgagactccgtctcaaaaaaaaaaaaaaaattatagagttggggtcttgctacattgccaagactggtcttgaactcctggggtcaagcatcctcctgtcttggcctcccaaagtgttgggattagaagcatgagccgctgtgcccagcctgacggggccttttagtgggaggagttgccattacactacgtccagtaagctccagactttcggaaaagattggtggacgggaatgctgtcatggatgggatcttgccaagaaccatcacgtgttaatttagttgcttaaacaaaaggtgttctgtttcttaactacttctgtgtctttactttttatttcattgttcattgtttttattttaatattcttttctgggtttatatgagacgagttttcactctgttgctgaggctgaagtgcagtggcgtgatcatagctccctgtagtcagccttcatctcctggactcaagcaatcctcccacctcagcctctccgg

SEQ ID NO: 89315 - DNA, 2178 bp, Homo sapiens
  misc_feature (65)..(65): n is a, c, g, or t
  misc_feature (796)..(796): n is a, c, g, or t
  misc_feature (1033)..(1033): n is a, c, g, or t
agaatttagctttttcaggaactgccatactggcttttcttttgtttttttgttttgagacagantctcactttgttgcccaggctggagtgcagtggcactctctcaggtcactgcaacctctgcctccgcagttcaagtgattctcatgcctcagcctcccaagtagctggaattacaagtgtgcaccaccacacctgtttttgtatttttttttttttatgagacggagtttcgctctcgttgcccaggctgaagtgcagtggtacaatctaggctcaccacaacctccacctcccaggttcaagcgattctcctgcctcagcctccccagtagctgggattacaggcatgcgccaccacacccggctactgtttttgtatttttaatagagatggatttttgccatgttggccagggtggtgttgaactcatgacctctagtgatccacctacttccgcttcccaaagtgctgggattacagacgtgagccactgtgctcagccccatactgggttttgtatcagcatgtatattttccattcccaccagcagtgcagactgttgcaatttctccacatccttggcaacacttactattttttattatggcctttctaatatgtgtgaagtggtatctcattgcggttttgatatgcattcccctaatgaccaatgacatcgagcatccattcctgtgtttattgaccatttgtgtatcgatttttgggggaaatgtaagatctgtaattttttttttttttttactctgtcgcccatgctggaatgcagtnctgcaatctcggctcactgcaagccctgcctcccgagttcatgtcattctcccgcctcagcctcccaagtagctgggactacaggcgcctgccaccacacccggctaattttttgtatttttagtagagacggggtttcaccgtgttagccaggatggtcttgatctcctgacctcatgatccacccgccctgccctcccaaagtgatgggattacaggtgtgagccactgcacccncccttttttttttttttttttttgagacagagtctcactctcattgcccagcctggggtgcagtggtgtgatcacagctcactgcagccttgacctccccagggctcaagtgatcttcccacctcaatctcccaggtagctgggactataggcttagaccaccacacctggctagtttttttgtttgtttgtttttggtttttttttggtaggtccggggtcttgtcatgttgctcaggctggtctcaaactcctgtgttccagtgatcacctgcctctgggcctcccaaagtgttgggattacaggtgtgagccaccacgcccaaccagatctgtaattttttttttctttgagactgagtcttgctctgttgcccaggctggagtgcaatgccacgacctcggctcactgcaacctctgcctcctgggttcaagtgattctcccacctcagcctcctgagtaactggggttacaggcatgcaccaccacgcccagctaatttttgtatttttagtagagatggggttttaccatgttggccaggctggtctcaaactcctgacctcaggtgatccgcctgcctcggcctcccaaattgctgggattacaggagtgagccaccatgcctggcacagatctgtaattttttaactagaaaataaaatcattatcttgtgctacctctcaagtatactcttgtctttttcagaagccttgaagaaccaatgtactgatgtggggattaaagagggtccactttccccagcacaaacctcacaagtcactagtctttcctcatggacggggtatttactttttcaaccagtggcttcttcccacttggagcaaagagaagccctgtggatagaggaaaaaggaactcctcaagcctcctgttcagattggatgactgtactaagaaaccaagactcaacttacaagaaggtggctttgcaggaggaaccagccagtggtataaatatgataaagcttatcagagaagatgggggatggatcgcgatccatccctttccccttaagtttcataagggctatcgtagttttctggggtagaacatgtagcccatttcttgccacctcatgggctacaccttgacctaacgtctttacgtgggtacttgc

SEQ ID NO: 89316 - DNA, 2830 bp, Homo sapiens
gaggagccgagcggaggaggcgtcccagggacacgcaggggaggccggccggcctgcacggggcgctcccgcctcgggggccctgtctggcgcctcagcgcgcgccccgatggtcacctgcgcccacctgggccggcgcgcgcggctcccggcagctcagccctctgcctgcccaggaacctgcttttcccaagaggagagaatggctgctgggtacctgccccgctggtcccaggaattagtaacctttgaggacgtgtccatggacttctcccaggaggagtgggagttgctggagcctgctcagaagaacctgtacagagaggtgatgctggagaactacaggaacgtggtctccctggaagccttgaagaaccaatgtactgatgtggggattaaagagggtccactttccccagcacaaacctcacaagtcactagtctttcctcatggacggggtatttactttttcaaccagtggcttcttcccacttggagcaaagagaagccctgtggatagaggaaaaaggaactcctcaagcctcctgttcagattggatgactgtactaagaaaccaagactcaacttacaagaaggtggctttgcaggaggaaccagccagtggtataaatatgataaagcttatcagagaagatgggggatggaagcagttagaggacagccatgaagacccccaggggcttttgagccaaaaggcatcccttcacgtagtggccgttcctcaggagaaggctactgcatggcatggatttggggaaaatggtaatctgagcccagcccttgttttatcacagggaagctctaaagggaaccacttgtgtggcagcgagttagatattacaagcttggcatccgattcagtcttaaaccaccatcagctgggatatgcagatcggagaccttgtgaaagtaatgaatgtggaaatgccatccgccagaacagtcactttattcaacacggggggaagatgtttgtgtatttggaaaatgggcagtcattgaaccacggtatggccctgactatccacaacaaaatcaacacggcagagaaaccctttgagtgccaccagtgtgggaaggtgttcaaccggaggcattctttgagcgaacatcaaagaattcacacgggggagaaaccctacgagtgtcaggagtgtgggcgagcctttacgcacagctccaccctcacgcgccatctgagaactcatactggagagaagccctacgggtgcggtgagtgcgggaaagccttcaacaggatctcatcgctgactcagcatcagaggattcacaccggggaaaagccctataaatgtgaagactgtgggaaatccttctgccagagctcttacctgatcttgcacaagaggacacacaccggagagaagccctacgaatgcagtgaatgtggaaaggccttcagtgaccgttcctctctcaaccagcacgagcgaactcacacgggcgagaacccctatgaatgtaagcagtgtgggagagccttcagccagaggtcttcccttgtgaggcacgagagaactcacactggagagaaaccctacaggtgtcaggaatgtgggaaagccttcagccagagctcatcccttgtcacacatcagaaaactcacagcagccagaaaacctataaaatcattgactgcgggaaagcgttctaccagaacagacatcttattggatattagcaattgcacgctgctttgtaagccactttttagtactctgacacatacatgtggttatcttttgccctgttgtgatggataatttgaaaagaagtgggtttatgtcaccttctcaccttcttataagaaagctctgagaatgggcatttttgtattttgttgttgttgttgagatggagtctgccacccaggctggagtccagtggcgtgatcatacctcactgcagcttcaacttcctgggctcaagtaatcctcccaccccagcctcccaggtagctagtactataggtgtgcaccaccacgcccagcaaatttttaaatttattatagagtgggaggcagggtgcggtggctcatgcctataatcctaacactttaggaggccgaggcgggtggatcatgaggtcaggagatcgagaccatcctggctaacacagtgaaaccctgtctctactaaaaatacaaaaaagtagccgggcgtggtggtgggcgcctgtagtcccaactactcaggaggctgaggcaggagaatggtgtgaacccgggaggtggagcttgcagtgagccaagatcgcaccactgcactccagcctgggagacagagcgagactccgtctcaaaaaaaaaaaaaaaattatagagttggggtcttgctacattgccaagactggtcttgaactcctggggtcaagcatcctcctgtcttggcctcccaaagtgttgggattagaagcatgagccgctgtgcccagcctgacggggccttttagtgggaggagttgccattacactacgtccagtaagctccagactttcggaaaagattggtggacgggaatgctgtcatggatgggatcttgccaagaaccatcacgtgttaatttagttgcttaaacaaaaggtgttctgtttcttaactacttctgtgtctttactttttatttcattgttcattgtttttattttaatattcttttctgggtttatatgagacgagttttcactctgttgctgaggctgaagtgcagtggcgtgatcatagctccctgtagtcagccttcatctcctggactcaagcaatcctcccacctcagcctctccgg

SEQ ID NO: 89317 - DNA, 254 bp, Homo sapiens
cacacagccaggcagataaaggagaaagaaggtgatctgaggctagagggtcaaaatgagcaatgggacaaagatagataaaagtgccaagtgttcagggatgcagccttggataaaagattctagctaggcagcaaaaaagcctaaggaatttaggctgagatattaaggctttgtttacgaagtatagaggagccactaaccactacagcccagaaatatccccaaggaaaaccctttggtcattcagcccc

SEQ ID NO: 89318 - DNA, 289 bp, Homo sapiens
acaaaacaaaacaaaaaacaacaacaaactgctgtgaacatgggtgtgcaagtatctgtttgaaaccatgcttcagttctttggatatttacccagaagtggaattgctgggtcctatgattattctatttttaattttgggaggaactgtgctccacggcagctgcacccttttccattcccaccagcaatgcacacgggttccagcatctccacatcctcaccaacacttgtgattttctggctagccaatagtttttgaatggatgcacgcatggctggtggctcg

SEQ ID NO: 89319 - DNA, 345 bp, Homo sapiens
tatgataaaaactttgaaacgttttgacgggtagcaatagaacttctaaacttttccatttattttagtaaatttcacttcacagtgaggcacacacaaggctgagtgcacacgggacatgggtgttcaccagcccaccgcaccctgcgccggcccacagcccagaggcctccaccggggagggcggtgggaggtgattccccgcctgcagtaacagcaccctgtggagtcccagggcgtcctctccacctgtgcaacccggctttaaactcacttgtggagctgtgcgcagcggcggctcgctgcaggtggctgccgtggcctccgtgtcagtgctgagtgtcc

SEQ ID NO: 89320 - DNA, 364 bp, Homo sapiens
agaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggaggtaaatatatataatcttacaattcctgactctcctctatcaggaatctcccagatcacccttttaagtgctggaatcttgtttttattgagtaaaccactgcataataaattaacatttggactcattct

SEQ ID NO: 89321 - DNA, 260 bp, Homo sapiens
aacactatttattaaacaccactacgtgttgtatactctatggcatagggtaattaggattccaagtttgcaccaaagaactctgacctacagaaagataagttacctgcccaaaatttgcaaatagtcaaataggaacttgaactcatatcatctgattctaaaatggcgtgttcatccaaccataaaatattgcctcaaaatatctaacttgagagttacgaagaggttggtgatatttcacatccattcttgagaca

SEQ ID NO: 89322 - DNA, 323 bp, Homo sapiens
tgcaatctgtttcctttgaagcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaaga

SEQ ID NO: 89323 - DNA, 1851 bp, Homo sapiens
ctgatttcaaaccactccttttcaaagatctctgagggagacattgcacctggccactgcagcccagagcaggtctggccacggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccggcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcaggaacctcggagtgatggtgtgttcctccctgtgtgacataggtgggataatcacccccttcatagtcttcaggctgagggaggtctggcaagccttgcccctcattttgtttgcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaaga

SEQ ID NO: 89324 - DNA, 460 bp, Homo sapiens
ttctgcccctgcattggaaaagcagctatagacaatgcatgaaggaatggttgtgtctggataccagtaaaatgctatttatggatgttgaaatttgaatttcatgtaattttttaagtatcttgaaatattttcattttttccaactatataaaatgtaaaaaccatttgtagctcactagttgtacaaaaacaggctataagctcgaatggggccacaggctgtagtttgctatgcccttttcttctttgctgtttgccatccttactttctctttgtcttgacacttattcatttctgtgtacaactttgcaacagttccatcatcaacaaactgattgcttatttatttattttaactccaacttttaattttgttgttacagaaaagcaaagcccaaagaaaacacgatttaccttaaggtccaaacctcagaaccctcgggcacctgagagaga

SEQ ID NO: 89325 - DNA, 1905 bp, Homo sapiens
ctgatttcaaaccactccttttcaaagatctctgagggagacattgcacctggccactgcagcccagagcaggtctggccacggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcaggaacctcggagtgatggtgtgttcctccctgtgtgacataggtgggataatcacccccttcatagtcttcaggctgagggaggtctggcaagccttgcccctcattttgtttgcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaaga

SEQ ID NO: 89326 - DNA, 1751 bp, Homo sapiens
ctgatttcaaaccactccttttcaaagatctctgagggagacattgcacctggccactgcagcccagagcaggtctggccacggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccggcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcaggaacctcggagtgatggtgtgttcctccctgtgtgacataggtgggataatcacccccttcatagtcttcaggctgagggaggtctggcaagccttgcccctcattttgtttgaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaaga

SEQ ID NO: 89327 - DNA, 377 bp, Homo sapiens
aaaccttaaaattagaagaaatttcctttattaaatatgaattttgctatattttagcatgtgttgggggttcccaagaccaccctcaggctcagtgattcgctagaagaactcacaggacccagaaaagctgttattcccttggtgttcaaggtttttattgtgggtcagtcacataggcatggagcacccatgtgagtgaccttagctgccgagtctccagccctcctttttcccttcccctccagaggtcaaactaatatggcgtagcccaaggccccagacaaagacaggtattcaccgtatatcatattgttagcataaactatctggcatgcccaaagccccaggtatactaagatactattgtcaggtgg

SEQ ID NO: 89328 - DNA, 332 bp, Homo sapiens
ctgcttacgcactgacatcattccttgggatctggatcaacacgaatttcaggaacttttaacctgaaatgactccttgggattatctaatttaaccttcccatttcacatgttagtaaactgagattcagagaagtagagttgtttatgctcatgagtgacttagtagcagagccaggataaaaacacagttctcctaatatgattattatgactgagagttattgttcactaattaggtaccaaggaagggtcttatgtcatggtcacaacccagtagagtcttctaaaaacagatttttccttatggcatttttatgtctcatacattt

SEQ ID NO: 89329 - DNA, 395 bp, Homo sapiens
ttggatgtctttatgcaatggcaagtttcagtatttctagctgtgtatcttctgtttatgtgctcctggacccgtgcattgtgtgtcttaatatgtgtttgccttggcgtgtttgtgaccttgtgtacctcagtgagggctcctaagtcagacagacttgggttccagctctggcacttgcagcgtaacctttaacttctcgaagtctcactttcttcatctataaactggggatagtgatactacttgcccctgaggtggtagatagatgtttgaaggatcaaatgaggtcacatgtgtgtggtgccccacacagtacctggcacatggtaagcatcaacaaatgtgagctgctacaaatgtcatgatgaggttgcttcgatctgtttgtggct

SEQ ID NO: 89330 - DNA, 974 bp, Homo sapiens
cccttccttggagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctg

SEQ ID NO: 89331 - DNA, 631 bp, Homo sapiens
cccttccttggagcgcagagctgcagccgccgagccggacgtgtccgcgaagatggcgggccgggttgtaaacatgttaaaggcatcctgttatatggacccccaggttgtgcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgatgagaggagacttccttgcttctttggagaatgatatc

SEQ ID NO: 89332 - DNA, 608 bp, Homo sapiens
cccttccttggagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagctcgccccctgagttctcacgagctgctaactcaggggcgagctgccaagccaggatatagaaacctcaacttgccaatgatagcctgtccttcaaaagcagtcctctgagtcagggaacttcctgttagcacatctattcccatgatctcaccccatcctccaatgtaatacagtatccccatgtataacacgactaccc

SEQ ID NO: 89333 - DNA, 286 bp, Homo sapiens
  misc_feature (22)..(22): n is a, c, g, or t
tgactctagaggaccccgcagnttaagggctacccagaaactacatctgtgaaggctttcaatggtaaacacccccatggaaatctttctcttcctccataaagagaaagggaaacctcatgctgccaaggaaatcctattgtctttgcaattagctgctttctcatctgttactcattctggtaaaaactacttccaacatacatattgacaaacagactatttcacaatactctcagacctggcaaccactaacttcctcgtgccacacccttcctcacttccc

SEQ ID NO: 89334 - DNA, 267 bp, Homo sapiens
ataggggagtagctagagagtagaggtgaagaaagtttttatgttgttttggtttgtttgttttcaaagatgaggcaaatatgtaaatgacaacaggaaggagccagcctgagaaacattttaagagacaaagaataactaacagcgtcaaaatttcttttattatgaaaagaaattaacagctaattaagcatatcctatgtaccaggcaatgatttttttttttttttttttttttagagaaaaaaaattttttttttttcccca

SEQ ID NO: 89335 - DNA, 448 bp, Homo sapiens
agaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgag

SEQ ID NO: 89336 - DNA, 1035 bp, Homo sapiens
  misc_feature (566)..(566): n is a, c, g, or t
  misc_feature (1001)..(1001): n is a, c, g, or t
gcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcagccgatttattttgcatattcccagcgaggaaagagacaatgcaatccgagtgtgttttcagattgaacttgcccattggttttacttggatttctacatgcagaacacaccaggattacctcagtgtgggataagagactttgctaaagctgtcttcagtcattgtccgtttttgctgcctcaaggtgaagatgtggaaagagtttggatgaatggaaggaatataaaatgggagtaccaacatatggtgcaattattcttgatgagacacttgaaaatgtactactggttcaggggtacctagcaaaatcaggctggggatttccaaaaggaaaagtanataaagaagaagctcctcatgattgtgctgctagagaggtctttgaagaaactggttttgatatcaaagactatatttgtaaggatgattacatttgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaacaaattccgcccagtancagttatttctgacggttctctggtgacagtggg

SEQ ID NO: 89337 - DNA, 874 bp, Homo sapiens
gcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcaggatatgtgaggattacttcatgaaaacaaggaagtgaattaaggaggatgaaaacaaaaagacaagacacatgacctctgtgggataaaggcacagggaactataggatgcttgtgaaagggcagtgtagagttgacagatgtgtaccaggtgtagaggacagctgatccagactagaacagatcagaagactagaagtcttaaagatgaaactgatgaatctgaattgtggggaaaaaaaatccaaaatgaaactgatggatctgaaaagaaaattcacaatggagatgattatgtcagaatatccaaaaaggagccaggagggcataaggagttggatcctggtcacatacacatctagatggagtttcacctgctgaactgggccaaagtgtaaaactagctgcatttgacttgagttgtatatactgggcctgatcaaccgcctggagagataaccatacccaactatattgatcattgactagagacatcctgagctgacaaccagccatcatttatcatggactgtgctaaaaccttccagatacgtaaatttacagtagcccttaaaagctctgcctaaccttgcctgaatgcaacatgatttagctgcttgctagacttgtgtctcccaaattgcaatct

SEQ ID NO: 89338 - DNA, 381 bp, Homo sapiens
tccctggatctgccaacagcttctgcacaccctgcaccttgctcacactggttcctgtgcttctctggcccacttctttccttgaaatctggtgggctgcacaacctaactgttaagagcactgactctagaagaactagtttgcctatgctcaaatcctgtctcagccacttactagctgtataaacttgggcaggttccttaacctctctctgcctaagtttactcatctgggaaactaatcgcagttctgacctcacggagttactgatatgggctaaattagtttacacagaccactcagaacactgcctggcacaaaggcagggctgaattagtatcattaaggtccccacccctccttggagggtactttttcca

SEQ ID NO: 89339 - DNA, 415 bp, Homo sapiens
tgacaggcatttgggccagataattctctgatgtgaggggctgtcctgtatgttgcaggatgtccagcagcatccctggcttctactcattggatgctagtaacaccaacccaggtgcaaaaattgaaaatgtccccgtgcattagcacatgccccatgcgggagagggcagcaaaatggcctcatcaaagatgattatttattgctctaaaataacgggaatattcagtcagcatcccttcttctcagatgattctgtattgagttttctcaaagcaaagctcacttcctcttgagtcgcaccctgtgattcattgttgattacaagtggcaaagaaactatgcattcatttattcactcacaatacatgtattcagtgcctgctctgtgcctagctgtggtggtgagcaaaat

SEQ ID NO: 89340 - DNA, 439 bp, Homo sapiens
tgcccctctctgcctgctgagtgtttccctggccgacctgaccacctccagctctctggtcccctcagccttcatgctttcccaacagaaagaacactgtatagtaacctggtcccaacatgcaacttgccccattacatcgatgcagcttgaagatagtgctgctgtaacccaggcagatgtcactgcctgtccaccactctcagccctggttcctcccaggcctcaaggctgcacagaaaggcactgtgctggtttccaaaccaccagcctcacgggaaaaggacatgtgcagtcctggcctccctgcagttagcatgaccccggcctggttttggggcatccccagaggccccgcaccgggtcccatggctttgggtcccaccacagctctcagtcccctcacccctgggcctgttcccccaagcccctcccatca

SEQ ID NO: 89341 - DNA, 447 bp, Homo sapiens
ctcgtgcgttttatttctgggtatgcttttagccagagaagaagtagttcagtttatggtctcatttctcatataaattgtgaaaattctccacggcttcacatgctagttcagaagatattgatgccttgagaataaagcatctggttgtaactccagcagttttatatttaaagtatacctaatataattgtcaaccacattactttagaaaacataaacaaaagatagttacacatatttattttaaaaatggtgactgggtgcggtggctcacgcctgtaatcccagcacgttgggaggccgtgactggcagatcacgaggttaggagatcgagaccatcctgactaacaaggcgaaaccctgtctctactaaaaatacaaaaaaattagtcggacgtggtggcacgcatttctaataagttctcaggtgatgctgatgctgg

SEQ ID NO: 89342 - DNA, 372 bp, Homo sapiens
attatttcaggattgtagtttatctaaaacaatatataacaacatttttgagcctgtggagttttttttaatgctttcgtattttgaaatttctataaagaacattttaaaatgttagtacttcttataattatttatataatgtcatcatacatatttggatcatgaatatagggagaatataaacaaaaccgtaatccagtcatccaaagataccatttgtaagtttttaaatcttcatcttatattttatcatgacaaagctaggcttagagcctcttatgaggaacactgcctctttcaaagcccctgccaaagaaatatgtttagcttgccatgtttgttactatttttctaatctctcctctccac

SEQ ID NO: 89343 - DNA, 115 bp, Homo sapiens
catgccactggtatttcaacatgggaaacaactatattctaaggaaaaagaagcaatcatacaataaaaatgctaaatcctttccaagcaataaattacctctttattttccttt

SEQ ID NO: 89344 - DNA, 270 bp, Homo sapiens
aaaaatccataacttagtaggtgttagtgtttctaaaacacttgattgctcttggttccaaataggttttcagtggggaaaaaaatacccatttagagaatatttgatatggcatatatgctctctttctaggggaaaatatccttctgggattcttaggatacctgtttttttttttgactttcagttttataaatagagctgacctaggtttacgggtttctttcatttctaaaattctgctgttttactagaactactattatcttt

SEQ ID NO: 89345 - DNA, 375 bp, Homo sapiens
agcagaaaaaatacccatgtgagttgctagaacacagcaaatgcagtgaagtatggtatataagatgggattttcagagtgtactggacgaagataaaatagggacttggaaataaggtgactgcatttttatcatatgtagaaaggcagtaactgggaaggtttaattatgtgtgtggggaggctgaagttttcttaactgattcacatatttcttatcactaataaaagaaacattctcccatctgctacctcttaggttagatgcctacatttgcctccataaaaatatgaactttgctgggcgcagtggctcacgcctgtgatcccaacattttgggaggccaaggtgggtggattacctgaggtcaggag

SEQ ID NO: 89346 - DNA, 350 bp, Homo sapiens
tgtgggaaggaccaatataagtttatccactaagtataataggtgaatatgactagacctataaattttagaaatagcctctaaatgtttttagttatcaacaaaaaacaatttatctcttttaataattagcttgaatgccacattcagggcttgaaaaaaaattagatagcaattattgtctaagagaaaatgagaaacataaggaaatgcgttagattataggtcaattaagaataccctggctggttgtggtgcttcacgcctgtaaccctagcactttggaaggctgaggcagatggattactggagtccaagagtttgagaccagcatgggcgacatggtgaaa

SEQ ID NO: 89347 - DNA, 395 bp, Homo sapiens
tgatctagaggatcgccgttactggcatttgggccacccagctctctatagaatttaaagattcctttttcccccctccctgaatcccagccttatttcttccaatccacaacacacatcctcaactacattcagttcaggttcaggcttcctgctgtgcctcaaatgcgtgaggtgcaatcttcccctcccctcttttccgaggagggatctcccctctctaagttttactagttccgtcaagaccaagcttcagttccacctcttttataaagcggctgcttgactttggcagccaaatttctagtatagtatttttaaaatctgcgccacacaatttcacccaatttatattgtgtggcttatggtttcatgtaattcgtctcatcgagtgt

SEQ ID NO: 89348 - DNA, 142 bp, Homo sapiens
gatctgtacatacagtgttaagaatgtagatattaaaattgttatatttagctgttacataatattaagactcagagttaagtaatttcactgaaattgattgctttttgtgtcttggagtcaaaataaataactgaaatct

SEQ ID NO: 89349 - DNA, 368 bp, Homo sapiens
ttctgggattacaggcatgagccaccacacccagctgacacctttcatttgttaagtctctgttatgtgccagatactatgctaataagctagcgtggattatgtcatttaatatgtatagctatttgatgaggtatttttctccctatttttgagaaaagcttggagaagtagttttccttgaaatcagacagccagtaagctgcagaaccaaaattcaaactcaggtctctgattccaaggcctgtagtgtatatatcaatttattgttatgttaagccttacatatactcttccataacatataataccatacctctatgcagtttattttatattgcatatttcagcatgtaactcgacctttt

SEQ ID NO: 89350 - DNA, 391 bp, Homo sapiens
cccaaggtcacaggtgggcagtgcccaaggtcacaggggggctatggtttccccactcagtccccaggcaggccccacctgggcactcccaccaggtcccagcagctgcggggggcccagggcggtgtccttgggcccagaggcccaggctgtaaagaaaccgcctgtctgcagggccccctgggagaacctttgccccccaggccccctccagtctcccaggaggctccaaagtccatgaggccccacctggggatgaggccacggcaggggtgggaggggtgcaggagctgggaggcacctggtcagctgcagcccttcagacgctctctttggccacagaattcagggaaatccaagaaagaatccaagtgtctagcgtttggggact

SEQ ID NO: 89351 - DNA, 420 bp, Homo sapiens
ggaaggagagaaaatggagtagagagactggaaagaaaggcaaggaccaaatcatggcaggggaggagggggttatgctcctttcaaggtgtttagatttgatcttagaaaaggggaaccactggtaaatcaatagcatgtaacatgatcagaactgtgtattagaataagtctgtggagaaataactagacaggagaaagttcagtggtaaagataaaaacttactggaaaggctcagttgggactcgcctgaactacgtcagtggcagtagaataaaggggaaaaatgcagtgtgtgtcaacagctctatgagaattttgaaggagaagttatcaagcttggatccagtttgagtgaagaggaggatagtagtgccattatttctagaaaaaatgcaggagcaaccaatctaagaaag

SEQ ID NO: 89352 - DNA, 422 bp, Homo sapiens
gaaacacaggggaaggaaatttttagaggaaatgtggaggcttggaatgctccacatttatacaatgtttacacactcaacattgtataaaaccagtatgaaagacaggattagtctgaatttcatgaaacattctcttgggcccctcctgcccacaacttcttttaaaaggaaaaatgaagtgcccaatcctcacatttcttcccatgcaagtgaacccctgaagaatggatgctgaggttggggctgctctctgatcagcaaattctgagatactagaaaaaaagaaggaggaagaggaagagaagcatgaggaagaaaaagaaggataagaggaagaaaaagagggagaaggaagaagaaaggaggaggaggaagaaggaaaaggagaagaggaaggaggaggagaaagaggaggagga

SEQ ID NO: 89353 - DNA, 309 bp, Homo sapiens
gcatcttaccttttaagccatgacatttttgaaattatacattctaagtaggctggataacattttaaacaaaacacaattgaaaattcagttcatcggagtcactgcacatactcaattgctgatttttatattgcagtatttttggctctaaaatcatgatgaaataacaccaaaagcaaatgggccatattatgcacaaattgtttgctaaatctaaattgctaaattgaggcttttttccagctgtgtcagaacaaaaatatattcagctacaaatatataaaatcgagatattttgaaggcaag

SEQ ID NO: 89354 - DNA, 635 bp, Homo sapiens
gttagataagaaaagtttaccaagtatggtattttttcatctatatctaatgcccttctaagtcaagtcttactcatttagaaaaagcaaaaatgaacaacgaaggattaataggttggagtagatttggattagaaaaaggagtaagttggaggtaatacggtgaaggagtaggaagaaaaatatttttgagttggttattctagaaatctgtttctgaataagccattaatcttacatattttaaatgaaaaataagatggagataaaaatttattatagcaacaggcataaactaaatcacagaggtaaatactttgttaaagattattggtgggtaaaaggcatctatgtaggttgctaactgtttttaaaaaaaacccactattttctgaatgaaacttattttcaaataagttattaggcaaatgtgagatgccaaatataaacatgtatttatttgtttattttaactttttattttttgagacagggtcatgtcattccctgtcacccaggctgcagtgagcagtgatcatgccactgcactcatcgtaggcaacagagtgagaccctgtctcaaaaacaaaacaaaacaaaacaaaaaacaagagtgtaagatacataaaaaaaaa

SEQ ID NO: 89355 - DNA, 741 bp, Homo sapiens
gattttaaaaatattgtcaacatttgtaagatctggataacttggtgaactagtattttccaaataaccaattaattatgttagaaaataatgcacaaattaaaagatccattcaaaatttaaaatacaggctgggcacagtggctcacacctgtaatcccagcactttgggaggcagaggcaggaggatggcttcagttcaggagttcaagactagtctggataacatagcgagaccttgtctctacaaaaaattaaaaatcagctgggcatggtggtgcacatctgtggtcgcagctattcaggaggctgggaggtagaagggttgcttgaacctgggagttcgaggctgcagtgagcagtgatcatgccactgcactcatcgtaggcaacagagtgagaccctgtctcaaaaacaaaacaaaacaaaacaaaaaacaagagtgtaagatacataaaaaaaaaaaaaaattaacacaacagagtataaaaagtctattagtatggtttcaggttctgcgttaaaactaaccttgaagaaactaccactttctgagttttaatgtagtatcaaagaataatatccatgaaaggactatttacatatttttcccttttcaactatacatgcgtataagcctggattttcttcatatactttaaccaaaacaacatattgcaagagactgaatggagaagcaaatgtgagaatccagctgtcttctgttgagctagacatta

SEQ ID NO: 89356 - DNA, 445 bp, Homo sapiens
ggggtcttaccatgttgtccaagctggtcctgaactaccagactcaatgttcctccagcctcagcctcccaaaagtgctgggttcacaggtgtgagccactgtgtccggcctccagactttcatactctgaccaacaacaaacccagaacccagaatagcacaccaatcagtgtgacaacttccctgtgagaataaagcaacacaatgagttatgagctcattacccctacacaaccatgtaggtgttggaaaaaagctgcaggtctgattcatgtactgaatcacaagaaaggagaaaggaaatttacatacttcacagagaaccaacccagaactgtcaagacctggtgtttctccatagggctgtgccacaactcccagggttaagctgcagctgctctggattcccttccttcttgggtcaccatgagggccatcttctct

SEQ ID NO: 89357 - DNA, 402 bp, Homo sapiens
tttcagtaaccgtatcaaaaagtcatactcaaattctatactaaaatatcttctcaagatttacatacacattcatcagtccctcaaattcatctacaagtttttttaatccctggggtttagaagtggttagagtgtaccccatttttggagctgggtgctttgcccttgttggttctcctcacctttttgataatagtgttagcagcccattcattaacatctgttgaaccacctgaattagactttgtctctttttctgctgctaatatcatatttttaaaaagctcattagttattcctctaatttctcaattttattttttaaatattttattggagttttaattttgcagtggtatttcaatttacaaaataaatattttatttaaatgttcttta

SEQ ID NO: 89358 - DNA, 452 bp, Homo sapiens
ccttctttatccgtcacatggcctgccctctatctcttaaatcttaggtctgttgtgagactggggaaggagtgatgtgaacatgtgctcctgggcctggaaatgcccctctgccccgactccttctgtctcagcagtgcttgtcattaattctcccaacaaatacctgagcccttctctgtgcaggatgggtctcagtgctttgaatgtgctgtctcgtttaattctctcaaaagccctttattgacaatgctcttataatattttatacagaaagaatggaaagctaatccaatctttttctaatgtggttaatcaaatttatttatttttaattaatggtggcttagaaagctttctttcagcattactatcctttatgagattgtcataaatgtttactatttttcattgttcatggcaaggcggcaatagatcttattcagaattga

SEQ ID NO: 89359 - DNA, 391 bp, Homo sapiens
tgattatggtggctgaggagtcccatgatacgatcgtctgcaagtctgagaaccagggaaggcagtagcataagtcccgaagtctgaaagcctgagagccgggagcaccgatgtcaggggaaggagatgatgaacgtcccagcttaagaagcaagggcaaatttgcacttccactgcctttttattctatccaagcccttggcttattggctggtgcctgcccacattggtgagtgcagatcttcctgtcctctgattcaaattcagtccactgattcaaatgccagtctctttgggaaacaccttcccataaacaaggttttactgttttaaaggatctgatgcatagaccctttttctgggtatcttttttaagctagtcaagttgaca

SEQ ID NO: 89360 - DNA, 407 bp, Homo sapiens
attacccaggagacttccaccccttcttctgtgcttgagctgtcttatctgtattttacagcctgaactttcaggttacttgttgttagaagagaagtgattttttttaactgtgtgtggttagaaagggagctatttttgagctgctttttgttaaaaggaaagttttctgctggggactcactttaccctaaatgtctacctaaataatttctttttgcctcctataacactggtagtgtcttccagcatgctaccctccagttagctccttgggggccaacaccttcatgctgggtaggtacagtgattctatgtgcaccacaaactacctggcctagcctctgcccccaagaccttgtctcagtagacttttggccagagaagtatcccctggttcttagctg

SEQ ID NO: 89361 - DNA, 1000 bp, Homo sapiens
  misc_feature (59)..(59): n is a, c, g, or t
tgtctagaggatcctgtcgacggtaccaacaccatacaccacatacatgggaagacttngtcttttgtctgtgtccttaaacagagttcacaaggatctctgtgcccttggcagaagatagactctaaattggcaccaagggaagatacaatacaaggtttcaacattcctggctacagccctctttgcttagaaatgagatgcctgtttcctcctctgcgcttctgttggagctgtgttctcttgagtggggcctgtgtgacaatccgtcagaggcaggaaggcttacacaggagtgcagctacaggaagtgagcaaagcaagcaacattgcaaacaactgaaattgggtcctgctcagagaacttcccaacctctgggaacactgctgacctcttcatcaacccttgcatggctgagaacagtaagatctcccccgatgtggaggcagtgggtctaggttgagcaatgacagaagagaacagcttgaacgaatcaacatatctgtgcagctcttcgcagcagacagttgtggtggacataaagcggctactttttttttcttcttcttcctgagaataattttagggcccaaagacctcccgaagattctgatgacatacacatttaggttccactccagctggagaaatcagctcatccagatggaccgctgatccaactttggagatgttccagaaacataaacttttatctccagagaaacaatagggtctgctctccccccagatggttttcatagttagcttattgtcttccccagaggtgaaaagtcaccattcacaatttatttactttaattcaaaaggcacaaccttcatttattcttttactgagggatagttacggatcacatctttggggatagcctctgtgctaggctccatggtcatggttagacatactcctgccttcccaagctcaggctccaatttgaaaggaaagaaaagcacctctatctgttggtaccgtcgaatgcg

SEQ ID NO: 89362 - DNA, 1019 bp, Homo sapiens
  misc_feature (78)..(78): n is a, c, g, or t
tgtctagaggatcctgtcgacggtacaacaccagcaccgtacacccaacaccatacaccacatacatgggaagacttngtcttttgtctgtgtccttaaacagagttcacaaggatctctgtgcccttggcagaagatagactctaaattggcaccaagggaagatacaatacaaggtttcaacattcctggctacagccctctttgcttagaaatgagatgcctgtttcctcctctgcgcttctgttggagctgtgttctcttgagtggggcctgtgtgacaatccgtcagaggcaggaaggcttacacaggagtgcagctacaggaagtgagcaaagcaagcaacattgcaaacaactgaaattgggtcctgctcagagaacttcccaacctctgggaacactgctgacctcttcatcaacccttgcatggctgagaacagtaagatctcccccgatgtggaggcagtgggtctaggttgagcaatgacagaagagaacagcttgaacgaatcaacatatctgtgcagctcttcgcagcagacagttgtggtggacataaagcggctactttttttttcttcttcttcctgagaataattttagggcccaaagacctcccgaagattctgatgacatacacatttaggttccactccagctggagaaatcagctcatccagatggaccgctgatccaactttggagatgttccagaaacataaacttttatctccagagaaacaatagggtctgctctccccccagatggttttcatagttagcttattgtcttccccagaggtgaaaagtcaccattcacaatttatttactttaattcaaaaggcacaaccttcatttattcttttactgagggatagttacggatcacatctttggggatagcctctgtgctaggctccatggtcatggttagacatactcctgccttcccaagctcaggctccaatttgaaaggaaagaaaagcacctctatctgttggtaccgtcgaatgcg

SEQ ID NO: 89363 - DNA, 416 bp, Homo sapiens
gagcaaaaagtactttcagcagataacatgctgtaagtttctgtttacatttctatcactaagaatggacacttcttaaatctgccgtgttcatagttgtaaattttctaaagcatgggatggacttggctccttgttattgtatttttgaatattcctgtgcatgaaattcaatctcctcttttcatagcaggaaatactggttttaaactatttcctacttaaatcaaaagattatatttcaaatatgatgaacacatgtcttgtgaatgaattgatataccatcttgcatctattttacacccattttctggataacagatgagtcacagtggctcataacagggcctcttagtaagccgagatcgcgccactgcactccagtctgggcaacagagcgagactccatctcaga

SEQ ID NO: 89364 - DNA, 188 bp, Homo sapiens
gatctaatgcaggatgtcagacttgtttctatccaggaataaaaccagttatgccagaagtaactattattcacctttctcctactgaattaaaatactatcagttgtatattaaatgctcacatctatttctgttctccatattctagcaatccttgacacttttcaatagcttttattacttggaa

SEQ ID NO: 89365 - DNA, 816 bp, Homo sapiens
cagaagtagttattaaaatatataggacctcacataggtagatacagaacttaccattgaggctgatgggctgttgtgtgaatcacacaggaccttaaatgaggctcattattctcacacaccaaaatgactctgacagcctgaagcagttattgctagagcccaagctttccttggaggttttggagttaggttgattggaagtaaccagctaataccttttctagtggagaaaaagacattgctaccagcttgttcatcccatagaagtcttccactctgctccatttttagcagcaagcatttcatgtagcataaaccttggcagataagtgtgcctaaggtttatacagtctgtccgcttggatgtatacaaatttagatacatattttaacatgtgttctcatagatgactttataacaacacacattacctataggtgtctagactgtgtacatacaagtgtgtacagacaagcttcatacgtatatactgtaatccgttacaacaaataaattttaaatcatcgtttaacatgtatgtggtacttctacagtgtacattgttttcattatttattgtaacattgaaaaccacagtgcagggaaaacaaaagtatcccagcatcttcatcctgtacacttggaattaatttcatttgggcatatccaagataaactcaactttcaagaaatcttgtatattatttaatcatctgtgttaggatgacacctatgattgatgacttcggttgaatagctttattctggatttttcataactaaagctaaatccaaagacctgaaaaaggaca

SEQ ID NO: 89366 - DNA, 1036 bp, Homo sapiens
cagaagtagttattaaaatatataggacctcacataggtagatacagaacttaccattgaggctgatgggctgttgtgtgaatcacacaggaccttaaatgaggctcattattctcacacaccaaaatgactctgacagcctgaagcagttattgctagagcccaagctttccttggaggttttggagttaggttgattggaagtaaccagctaataccttttctagtggagaaaaagacattgctaccagcttgttcatcccatagaagtcttccactctgctccatttttagcagcaagcatttcatgtagcataaaccttggcagataagtgtgcctaaggtttatacagtctgtccgcttggatgtatacaaatttagatacatattttaacatgtgttctcatagatgactttataacaacacacattacctataggtgtctagactgtgtacatacaagtgtgtacagacaagcttcatacgtatatactgtaatccgttacaacaaataaattttaaatcatcgtttaacatgtatgtggtacttctacagtgtacattgttttcattatttattgtaacattgaaaaccacagtgcagggaaaacaaaagtatcccagcatcttcatcctgtacacttggaattaatttcatttgggcatatccaagataaactcaactttcaagaaatcttgtatattatttaatcatctgtgttaggatgacacctatgattgatgacttcggttgaatagctttattctggatttttcataactaaagctaaatccaaagacctgaaaaaggacaaaaagaaaaaaaaaaaaagaaaaaacaaagaaaaagaagaaaaaataataaagtcaagcgcaaactgatggggagacagtgggctctggtttccaggattgagacaatggtactgcggtcttggggagactgcgttagctagtggggagtggtgatttttttcatgcttgtcacatctaaatggtctttaacatgagaaagttttagaggttataatttc

SEQ ID NO: 89367 - DNA, 2061 bp, Homo sapiens
agaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcggccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtaccttaaaaatatagctaagttggtttttgaatataaaacagtttatgaatatgtgcattttctggtatggttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtaaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagc

SEQ ID NO: 89368 - DNA, 2228 bp, Homo sapiens
gtaagcagagatggacagtatattcaagaaatctgattaagataacacctaaagaagagaaggtccatccataggttggctgagttcttatttctgaaataatctctggaggaacttttaagaatcctgaaagattcaactattttaaactcttctggaaaagtatatgcatatactcctttgaaacccctatgattgtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcggccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtaccttaaaaatatagctaagttggtttttgaatataaaacagtttatgaatatgtgcattttctggtatggttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtaaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagc

SEQ ID NO: 89369 - DNA, 1745 bp, Homo sapiens
aacacacgtgcgtgcacacacacacacacacatttattataaggaattggcatatgtgattatggcaactgggaagtccaagaatctgcaatgtggtctggcaggctcaagacccaagagagctgatggtgcagttccagtctcacagaagtctgctggagaatttcctctggcttggagaaggtggtcttttcattctactcaggtcttctattgattggataaagtgcacatacatcatggagggcaatcttctttactcagaggacatcagtgtcaatgttattcccatccagaaacaccttccaagttgacacataaaattaacaatacacttttcctcatctcacccaaatttaggttaagagttctggatacctgaattaatattgccattggaatgccacttttacttttggagaaaaattagaaataacattttataaaattaaaaaactgtaggctaggcacactggtttacacctataatcccagcacttttggaggccaaggcaggaggatcccttgagcccaggagttcaagtctagcctgggcaacataaggagatcctgtctctacaaaaaaaaaaaaacaaaaaaactgtagctaggcatggtggcatgtgcttgtagtctcagatactcagaaggctgaggtaggaggatcccttgagcccaggagttcaaggctgcagtgagctgtgattataccatggcactccagcatgggtgacagagcaagactttatctcaaaaagaaaaaaaaatactgtgtttctggtttgcaattatactgagtattccagatatgaagtgaccagctcatagcacttgcaacaagattattctcttctgtagtctggttgctatatttctaataatgtgactcaagatttcattcattttacctctggacttatcactctttgaactttacggtttatcactaggtctttttctctaaatgagctattgttaggccagttttcttcttcctcttgcaatcctgtttttcagtggttgatggcatttaacctaacgtggattttcacataacaattgctattttaaaatgttattagttacttaacccatatgatttatcttagaaccacagaacctcagagctaaaatgaacattttataataacaaaccgggtccaaaataaatgacttacatagatttataaggtaattaatgacagagctgagtcaaggattcatgtttcttgatgcctagtttagtagtctttgatgcaacagacatcaagtacatattatatctagaagtaatgtattaaagataatcttttggcttaaatcattttagaatgtgtaacatccttgtaatacaagtcattacccatttcaactagagaagaagatatatagaaatatcaaatgttaacaaggtaataggccattgcttttgtgtaattcaaaatttgataatgattttgttctttgccctagttattgataaaattcttaaagtgaacattgccctactgcctatttctaggtgctgttccctttaataagtatattttgaacatcatttgtttaaccctgttttaaccaattagaaatctatctacttgaattatgttcattctcttccctatgtattctttttgagtaacaaaatgagattattttaatatgactagaaaggaaatatatcttaatatgagagtgtacaaacttttgttgtcttaaataaagattgacatgtcaaatctgaa

SEQ ID NO: 89370 - DNA, 215 bp, Homo sapiens
ggctttgttgttccattcatagagcacaggcagagcatatttagtataattcttaagggctctaggattttcaaaatggtaaataaccatcggcttcaacttaaagtcaccagctgtattagcccctaacaagagagctgacttgtcctttgaagctttgaagccaggcattgatttctctccagttacgtttatttatttatttatttttcttt

SEQ ID NO: 89371 - DNA, 401 bp, Homo sapiens
ctctctgccatgctaaccaacgtagaagagaataagataaagcaatgaaaagcagagtggcactctgatatataagattctctaagaaatatagagtgaattttgcccaaaggccctcactgaactaattcctgaaccaaaagagtatttcttaatccaaaactttacagtattagacctacgaattctgatgatgcctgatcagatgctagttgttctcgacaatccatgcagttttccagtatgaaggaaagtaacaaatataccatggttattcttatttctttctgaaaaatatctaggatattttatagtgtcatgtggtaaaatattcatttgacaatcacaatgaagtataatcagaagtattagcaattttactttgtttatcctgttaatcc

SEQ ID NO: 89372 - DNA, 371 bp, Homo sapiens
ttctctttctccaccacagaaggggtgtctgagcaggatggaggcagcacgctgcagcgggccgctgtctccagagaagacagcgggacctatgtctgctgggcggagaacagagtgggccgcacgcaggcggtcagcttcgtccacgtgaaggaggctcctgtcctacaaggggaggctttctcctacctggtggaacctgtaggaggcagcattcagctagactgtgtggtgcgtggagacccagtgccggacatccactggatcaaagatggccttccactgcggggcagccacctccggcaccagctgcagaatggctcgctgaccatccgcaggactgaggcaaggcggggcctggcaccttgggt

SEQ ID NO: 89373 - DNA, 365 bp, Homo sapiens
gagaattggttggtttgcgtatgaaaggtgtgctccgggggaggttggtggggatagtgcgctctctagccagccctggaaggagtggtctctccaggattagcaaggccccaagatgtcaaagcatcataaaactcagaaaataaaaaacatgacttttttttagagcccaattctcactctgttcctcaggcaagagtgaagtggtgcagtgatagctcactgcagcctcgaacttctgggctcaagcgatcctcccacctcagcctcctatgtagctaggactacaggcaagcaccactatacccagctaattactttttaaaattttttgtagagacagggtctcgttatgttacccagac

SEQ ID NO: 89374 - DNA, 823 bp, Homo sapiens
gggctaagtactttgcctggattatttaatttaatcttcgcaatagccttagaaggtaagtgctgtttttattcccagttttctaggaaatggagccacagagagctgaaatgccttgcacaaggtcacatagctccaaggtgtgatgccaggaatcagacccagattgtgtgtctctgtgctctactggggactgatgtgctgggatgagtttaataggcagcatgacttcctattactgggacagaggattcctgacactcttcaagtcaaagctgagatgtgcccctcttttcagaatagttaaggatggcctaggaaatgagtacccagatgcttcttgggcaaaaatttgcttgccagtcctgtttgagtttgggaatcattgctgccactgggtccaggctgggtgggctggggaaccccactgagagtgaccacccctggcttcccctcaggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggtgctagcatcacagggctccttctgactcagcccctgagtcacccagaacatgaaaatagtcaagattgggggtggacctgggcaacatggtgaaaccccatccctaccaaa

SEQ ID NO: 89375 - DNA, 686 bp, Homo sapiens
gaccgactgtgtggaagcaccaggcatcagagatagagtcttccctggcattgcaggagagaatctgaagggatgatggatgcatcaaaaggtgagtgggtgaaatctccatggagccccacatgccccttcagccagctggccctaaactgctctcttgcctctgccgggtgcctggggccattgccctctcaccctgacttgtggccctggtgctgcttgctttctgtctcatccctttttagaaaacccacaaacttttcatttaggcataatttcagatttacaaaaagattgcaagaataaaaagaagaatttccatatatcctttatccagattccctaaattattactgcatttgctttatccttctcgatcagtggacagatagatgatatagacagatagatagacaaatatatattttttgaactcttgagagtaagttgcagatattacattattaaatatttggtgtgtatttcctaaagacaaggacattctcttacgtaaccaatacaattatgaagaccaggacatgaacaccatttcaatactgttatccaacccacagattttatgcagattcatcaactgtcccaataatgtcatttatagcagaagaaatcctgggttaggcttgattccgttgttgtgcctcttcggtcccctttgtctggaatag

SEQ ID NO: 89376 - DNA, 582 bp, Homo sapiens
  misc_feature (514)..(514): n is a, c, g, or t
  misc_feature (540)..(540): n is a, c, g, or t
  misc_feature (563)..(563): n is a, c, g, or t
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaagggggccattggnttttaatgccttattgaggccgggcnaaaaagggttcaatccttaaatncaacggggtttccatttcg

SEQ ID NO: 89377 - DNA, 227 bp, Homo sapiens
gaccgactgtgtggaagcaccaggcatcagagatagagtcttccctggcattgcaggagagaatctgaagggatgatggatgcatcaaaaggaggtcaggacatccaaatagggacctggaagatggtgatatgtgtgggataaaggagtatcactggtgcagtcgctagaaggctctctggcaacatttgctgaaattaaagatgcccatatcctgtgacacagca

SEQ ID NO: 89378 - DNA, 3127 bp, Homo sapiens
gaccgactgtgtggaagcaccaggcatcagagatagagtcttccctggcattgcaggagagaatctgaagggatgatggatgcatcaaaagagttgaggtctcactttgttgcccaggctgcgtgttgtggctattcacagctgcaatcatagctcactgcagcctcaaactcctgggctcaagtgattctcccacctcagtctcccgagtaaccgggattacagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctactt

SEQ ID NO: 89379 - DNA, 2928 bp, Homo sapiens
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctactttcaggggacgaaccaacaaaacacacaaaacaacaaaaaaaa

SEQ ID NO: 89380 - DNA, 1097 bp, Homo sapiens
  misc_feature (22)..(22): n is a, c, g, or t
  misc_feature (27)..(27): n is a, c, g, or t
atgcagggaatttcggaacganggacntgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctactt

SEQ ID NO: 89381 - DNA, 1403 bp, Homo sapiens
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggtgctagcatcacagggctccttctgactcagcccctgagtcacccagaacatgaaaatagtcaagattgggggtggacctgggcaacatggtgaaaccccatccctaccaaa

SEQ ID NO: 89382 - DNA, 2995 bp, Homo sapiens
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctactt

SEQ ID NO: 89383 - DNA, 2886 bp, Homo sapiens
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctactt

SEQ ID NO: 89384 - DNA, 2306 bp, Homo sapiens
gggctaagtactttgcctggattatttaatttaatcttcgcaatagccttagaaggtaagtgctgtttttattcccagttttctaggaaatggagccacagagagctgaaatgccttgcacaaggtcacatagctccaaggtgtgatgccaggaatcagacccagattgtgtgtctctgtgctctactggggactgatgtgctgggatgagtttaataggcagcatgacttcctattactgggacagaggattcctgacactcttcaagtcaaagctgagatgtgcccctcttttcagaatagttaaggatggcctaggaaatgagtacccagatgcttcttgggcaaaaatttgcttgccagtcctgtttgagtttgggaatcattgctgccactgggtccaggctgggtgggctggggaaccccactgagagtgaccacccctggcttcccctcaggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctactt

SEQ ID NO: 89385 - DNA, 3281 bp, Homo sapiens
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctacttcaagaaaactctgtggtccctgagtccttttttctttatgccaataagcttcttaaatgtgctggcggtttatgcagtcacttggggagccatggaatcctttgatctccccaggcaaggtgctctgaggagttggcttctttattgtctgttcagtacatccaacccctctctcaaaggctgtcaccccaactggatacacaccctggcaaaggcacgtagcttgaatgagggttattttgtgtctaattcacaggagagtcatgggtgggatacctgtcatcctctgcctttccagctgtccaagtgaaaaaaacctcaatcctggtcacccttgcccaagttgcccacatccctggcatacagtaggtgttcaataaatgtttattgaagga

SEQ ID NO: 89386 - DNA, 2884 bp, Homo sapiens
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagaaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctacttcaagaaaactctgtggtccctgagtccttttttctttatgccaataagcttcttaaatgtgctggcggtttatgcagtcacttggggagccatggaatcctttgatctccccaggcaaggtgctctgaggagttggcttctttattgtctgttcagtacatccaacccctctctcaaaggctgtcaccccaactggatacacaccctggcaaaggcacgtagcttgaatgagggttattttgtgtctaattcacaggagagtcatgggtgggatacctgtcatcctctgcctttccagctgtccaagtgaaaaaaacctcaatcctggtcacccttgcccaagttgcccacatccctggcatacagtaggtgttcaataaatgtttattgaagga

SEQ ID NO: 89387 - DNA, 678 bp, Homo sapiens
gaccgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtgagcacccactgggctggcgggtgggctggctggcttctggcggaatgctcctaatgtgagcagcccctatccccttcctcacctgtcagctggtaacatggtttaaagccatccacagcacagcatgatagaggggccatggctccaaatgtctgtttccccactcagcctcctccaagcacacagtatcgctgtggccaaacctcctacatgtcacccttcccctttccatttcaaagggaacaatgttcactggaggacatgagcggagagaagtacataaaaataacccatggttccacc

SEQ ID NO: 89388 - DNA, 129 bp, Homo sapiens
aaaatcttactcaaatgaaagcaaatccaaaaatgagaagaggagatagctaatcagataagaaggaaccagagagataatcctggaagaatgaaaacacagagtgttaaaacactaactgcccagcaa

SEQ ID NO: 89389 - DNA, 632 bp, Homo sapiens
gacagagtgagactcaggtctcaaaacagaaacagacatagaaaaaatctttgctgaatcgaacatgtgactaattgcataagacatttaaaacacaagatgtatgagaaataaaaaataacaaggtcacaaacctaatggctgaggaagcctatgatacaaatcaagaatttgaaaatggaaaacaaaaagatgataatgaatgtgatttatacactctgcaacatggaaaatctaagtggataatcctggaatcaacgagaaatataggactggggctcatggaaagcatctggcctagaaagagatctggaaatgaataaattgagatttggggacatatactaatttgtaccaaagtaacataacaaagcctaatcgccaaaaatatataaaataaaaggagacatgtaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaagaaaaaaaaaaaaaaaaaaaaaggagggagggcgggagagcgatacattgccacacgacgacacaagtacatacgagaaacgacacgagaacgagacacccacggagcgcagcagaaaagcg

SEQ ID NO: 89390 - DNA, 402 bp, Homo sapiens
cccaccccttttgcaatctgatcacagtgagagccgacatgtgagccaaagtcctcgaggaggtttcctttataaataaaaaggccaagtcttgctaagaagaaagttttgcaatttttccttccctgtttttcctatgaaagccacatattaagaatgattggacagaagggtaaaaggtccaaaatgaattccatgagtgcctgtagcagcctttgggatcagaaaactaacccccatatctacttaagacttcggttgcatatttttttgttgttgatggggaacacattccttaactgaaacaaggaattggtttcctattctgaatgaagcccagtttgatttgggtttctgtcatctgcaagtgagagatgcggtgtttggcgatcctcagacgca

SEQ ID NO: 89391 - DNA, 253 bp, Homo sapiens
ctttaatttcctgagtgtgttacaaagtgcattgaattatatttgacatatggaggttctaaagccatgtcaggcttctattaacatatgataatagaaagcaataggaagtccagcaatctgtgagatcccatggcccttccacttcctccccatggctgtaggcacaccgcccatcttctgtgagcttcactttcaccactcctaaaatggggatgaaatatcagcctggactgttgttcagattgctatg

SEQ ID NO: 89392 - DNA, 554 bp, Homo sapiens
  misc_feature (13)..(14): n is a, c, g, or t
gatctgactgctnntcttcatgggagacttcaggttctgagttcctgaatgtatcctccgtctacaggagagagggggctctggtcctgacttggcttcctcctgtctttgctgatggaagctgggttttgatgagaaacttctcctggcatgctaaggtctactcacagcaaatgtaaagtcttagaggtcgaaggccttgataactgcctttcctgaccttgcactgtttctagtgagtttaatttaatacaaagcaaaacaagtttgatgatagcctctggctgactgctggaacccaccacgctcacggactgtgggtcccggcagaatgtggctccatggacagagggtctctgcttcataccccgctgcacccccagggccagagaggtgcttgcatggaggagctattcaatacgtttagttgaatgaacaagcaaatgaatgaacaaaatattgtttaaagtatccatgttacaccaaaaatataatgcaattttctgatgtcttaaatcaaattctccagtggcaataaacataacaaaaactca

SEQ ID NO: 89393 - DNA, 410 bp, Homo sapiens
aaaaacaattacagaaatttcttcaagttctaagaaaaatactgtctttccttttcccagtatgttctctatacccataggtatccttcaaatactgcctaagacattccctattgagaaggccccagccagctagctgttcccagtgctcctgcctccacgctcacggactgtgggtcccggcagaatgtggctccatggacagagggtctctgcttcataccccgctgcacccccagggccagagaggtgcttgcatggaggagctattcaatacgtttagttgaatgaacaagcaaatgaatgaacaaaatattgtttaaagtatccatgttacaccaaaaatataatgcaattttctgatgtcttaaatcaaattctccagtggcaataaacataacaaaaactca

SEQ ID NO: 89394 - DNA, 207 bp, Homo sapiens
tcaccaacagcccttaacacctgaccagaaagcattccatggcctcaaatctgatcagatgtgaggaaaatgggtgagatgtgctgcctacgttactcctgttctaaacacaaatccactctgcccgtggacccccatgccactgtccactcagcaaacacaaatccactctgcccatggcccccatgccactgcccactcagcaga

SEQ ID NO: 89395 - DNA, 362 bp, Homo sapiens
aatagagaaattgtctaaaaaaatacctggcctatattctttcatggcagtgtcatgaaagagaaaaaaggctgaagaactgttttgcattaaaggagatttagagatgtgagttgaaactaaatgccatgcaggatcctgggttgaatcctagactggaaattatacttaaaaaggacattatggagaaacttggcaattgaatatggactgtgaattatatcaggtgtttgaaaaattttaaaataaaagaagaaatacatattttagaatttgcaggcaatactgttgtctcatgcaacaactatccaattctgctgttgttcacactgctgccacaaataatgcagaaaagaaggggc

SEQ ID NO: 89396 - DNA, 2573 bp, Homo sapiens
  misc_feature (1)..(1): n is a, c, g, or t
  misc_feature (7)..(7): n is a, c, g, or t
  misc_feature (24)..(24): n is a, c, g, or t
  misc_feature (30)..(30): n is a, c, g, or t
  misc_feature (32)..(32): n is a, c, g, or t
  misc_feature (73)..(73): n is a, c, g, or t
  misc_feature (94)..(94): n is a, c, g, or t
  misc_feature (100)..(100): n is a, c, g, or t
  misc_feature (167)..(167): n is a, c, g, or t
  misc_feature (380)..(380): n is a, c, g, or t
  misc_feature (388)..(388): n is a, c, g, or t
  misc_feature (395)..(395): n is a, c, g, or t
  misc_feature (443)..(443): n is a, c, g, or t
  misc_feature (447)..(448): n is a, c, g, or t
  misc_feature (528)..(528): n is a, c, g, or t
  misc_feature (539)..(539): n is a, c, g, or t
  misc_feature (545)..(545): n is a, c, g, or t
  misc_feature (554)..(554): n is a, c, g, or t
  misc_feature (576)..(577): n is a, c, g, or t
  misc_feature (739)..(739): n is a, c, g, or t
ntaagtnaaataagtgccgagggntggagnangggctggttggagtgggggtctccatcatctccagcaaaangctgtgctgaagtctgagcanagggangggctcagagagaggggctgcccgacccttccatctaggagctgcccaggactccagaggagggganggaattgatttaggtcagtgaggggttgcgtggggctgggagggggttgaggttgggaggctgaaggaggagactcccttcaacctgggaggtggaggttgcagtgagcagagatcgtgccactgcacaatcctttctatctcccttcctgggctgtgagtttctcggggcagggaaacagatcactcatccatctgtcacgttgtgatgtanactagttncctgatntatatactagtactcagaaaaatgtctgatgaatgaataaaattcatncatnnaacattttcatcatagcattggctattaaccccttgaatccccgtggctcacttgctgggtcccatccctgacccactancctggtgccgngggganaccaatttntggaggaagctctgggtacccnntcttgccctaagcctgcctctgaacaggctgttcttgtttatgacccccgtcccagcagaatagtgattgctcatccctgcatgtgatttgagagggccagtctttcaggcctggaggaaactcaagccccaccagccgcttggcatcggaatgctcagctngtcccctcctggggctcatgtgaccaagatctagctataaatatcagaggggcctcagaccaagacagaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccaggatgggaatcccatggagaacttggagaagcagctgatctgccctatctgcctggagatgtttaccaagccagtggtcatcttgccgtgccagcacaacctgtgccggaagtgtgccaatgacatcttccaggctgcaaatccctactggaccagccggggcagctcagtgtccatgtctggaggccgtttccgctgccccacctgccgccacgaggtgatcatggatcgtcacggagtgtacggcctgcagaggaacctgctggtggagaacatcatcgacatctacaaacaggagtgctccagtcggccgctgcagaagggcagtcaccccatgtgcaaggagcacgaagatgagaaaatcaacatctactgtctcacgtgtgaggtgcccacctgctccatgtgcaaggtgtttgggatccacaaggcctgcgaggtggccccattgcagagtgtcttccagggacaaaagactgaactgaataactgtatctccatgctggtggcggggaatgaccgtgtgcagaccatcatcactcagctggaggattcccgtcgagtgaccaaggagaacagtcaccaggtaaaggaagagctgagccagaagtttgacacgttgtatgccatcctggatgagaagaaaagtgagttgctgcagcggatcacgcaggagcaggagaaaaagcttagcttcatcgaggccctcatccagcagtaccaggagcagctggacaagtccacaaagctggtggaaactgccatccagtccctggacgagcctgggggagccaccttcctcttgactgccaagcaactcatcaaaagcattgtggaagcttccaagggctgccagctggggaagacagagcagggctttgagaacatggacttctttactttggatttagagcacatagcagacgccctgagagccattgactttgggacagatgaggaagaggaagaattcattgaagaagaagatcaggaagaggaagagtccacagaagggaaggaagaaggacaccagtaaggagctggatgaatgagaggcccccagatgcagagagactggagagggtggggaggggcccagcggccttggtgacaggcccagggtgggaggggtcggggcccctggaggggcaatggggaggtgatgtcttctctctgctcagagagcagggactagggtaggaccctcaccgctgcgtccagcagacactgaaccagaattggaaacgtgcttgaaacaatcacacaggacacttttctacattggtgcaaaatggaatattttgtacatttttaaaatgtgatttttgtatatacttgtatatgtatgccaatttggtgctttttgtaaaggaacttttgtataataatgcctggtcattgggtgacctgcgattgtcagaaagaggggaaggaagccaggttgatacagctgcccacttcctttcctgagcaggaggatggggtagcactcacagggacgatgtgctgtatttcagtgtctatcccagacatacggggtggtaactgagtttgtgttatatgttgttttaataaatgcacaatgctctcttcctgttcttcaaag

SEQ ID NO: 89397 - DNA, 2002 bp, Homo sapiens
  misc_feature (1)..(1): n is a, c, g, or t
  misc_feature (7)..(7): n is a, c, g, or t
  misc_feature (24)..(24): n is a, c, g, or t
  misc_feature (30)..(30): n is a, c, g, or t
  misc_feature (32)..(32): n is a, c, g, or t
  misc_feature (73)..(73): n is a, c, g, or t
  misc_feature (94)..(94): n is a, c, g, or t
  misc_feature (100)..(100): n is a, c, g, or t
  misc_feature (167)..(167): n is a, c, g, or t
  misc_feature (380)..(380): n is a, c, g, or t
  misc_feature (388)..(388): n is a, c, g, or t
  misc_feature (395)..(395): n is a, c, g, or t
  misc_feature (443)..(443): n is a, c, g, or t
  misc_feature (447)..(448): n is a, c, g, or t
  misc_feature (528)..(528): n is a, c, g, or t
  misc_feature (539)..(539): n is a, c, g, or t
  misc_feature (545)..(545): n is a, c, g, or t
  misc_feature (554)..(554): n is a, c, g, or t
  misc_feature (576)..(577): n is a, c, g, or t
  misc_feature (739)..(739): n is a, c, g, or t
ntaagtnaaataagtgccgagggntggagnangggctggttggagtgggggtctccatcatctccagcaaaangctgtgctgaagtctgagcanagggangggctcagagagaggggctgcccgacccttccatctaggagctgcccaggactccagaggagggganggaattgatttaggtcagtgaggggttgcgtggggctgggagggggttgaggttgggaggctgaaggaggagactcccttcaacctgggaggtggaggttgcagtgagcagagatcgtgccactgcacaatcctttctatctcccttcctgggctgtgagtttctcggggcagggaaacagatcactcatccatctgtcacgttgtgatgtanactagttncctgatntatatactagtactcagaaaaatgtctgatgaatgaataaaattcatncatnnaacattttcatcatagcattggctattaaccccttgaatccccgtggctcacttgctgggtcccatccctgacccactancctggtgccgngggganaccaatttntggaggaagctctgggtacccnntcttgccctaagcctgcctctgaacaggctgttcttgtttatgacccccgtcccagcagaatagtgattgctcatccctgcatgtgatttgagagggccagtctttcaggcctggaggaaactcaagccccaccagccgcttggcatcggaatgctcagctngtcccctcctggggctcatgtgaccaagatctagctataaatatcagaggggcctcagaccaagacagaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccaggatgggaatcccatggagaacttggagaagcagctgatctgccctatctgcctggagatgtttaccaagccagtggtcatcttgccgtgccagcacaacctgtgccggaagtgtgccaatgacatcttccaggctgcaaatccctactggaccagccggggcagctcagtgtccatgtctggaggccgtttccgctgccccacctgccgccacgaggtgatcatggatcgtcacggagtgtacggcctgcagaggaacctgctggtggagaacatcatcgacatctacaaacaggagtgctccagtcggccgctgcagaagggcagtcaccccatgtgcaaggagcacgaagatgagaaaatcaacatctactgtctcacgtgtgaggtgcccacctgctccatgtgcaaggtgtttgggatccacaaggcctgcgaggtggccccattgcagagtgtcttccagggacaaaagactgaactgaataactgtatctccatgctggtggcggggaatgaccgtgtgcagaccatcatcactcagctggaggattcccgtcgagtgaccaaggagaacagtcaccaggtaaaggaagagctgagccagaagtttgacacgttgtatgccatcctggatgagaagaaaagtgagttgctgcagcggatcacgcaggagcaggagaaaaagcttagcttcatcgaggccctcatccagcagtaccaggagcagctggacaagtccacaaagctggtggaaactgccatccagtccctggacgagcctgggggagccaccttcctcttgactgccaagcaactcatcaaaagcattgtggaagcttccaagggctgccagctggggaagacagagcagggctttgagaacatggacttctttactttggatttagagcacatagcagacgccctgagagccattgactttgggacagctgaagatgatgaggatgacgatgtcgataccaagaagcagaagaccgacgaggatgactagacagcaaaaaaggaaaagtt

SEQ ID NO: 89398 - DNA, 1914 bp, Homo sapiens
  misc_feature (1)..(1): n is a, c, g, or t
  misc_feature (7)..(7): n is a, c, g, or t
  misc_feature (24)..(24): n is a, c, g, or t
  misc_feature (30)..(30): n is a, c, g, or t
  misc_feature (32)..(32): n is a, c, g, or t
  misc_feature (73)..(73): n is a, c, g, or t
  misc_feature (94)..(94): n is a, c, g, or t
  misc_feature (100)..(100): n is a, c, g, or t
  misc_feature (167)..(167): n is a, c, g, or t
  misc_feature (380)..(380): n is a, c, g, or t
  misc_feature (388)..(388): n is a, c, g, or t
  misc_feature (395)..(395): n is a, c, g, or t
  misc_feature (443)..(443): n is a, c, g, or t
  misc_feature (447)..(448): n is a, c, g, or t
  misc_feature (528)..(528): n is a, c, g, or t
  misc_feature (539)..(539): n is a, c, g, or t
  misc_feature (545)..(545): n is a, c, g, or t
  misc_feature (554)..(554): n is a, c, g, or t
  misc_feature (576)..(577): n is a, c, g, or t
  misc_feature (739)..(739): n is a, c, g, or t
ntaagtnaaataagtgccgagggntggagnangggctggttggagtgggggtctccatcatctccagcaaaangctgtgctgaagtctgagcanagggangggctcagagagaggggctgcccgacccttccatctaggagctgcccaggactccagaggagggganggaattgatttaggtcagtgaggggttgcgtggggctgggagggggttgaggttgggaggctgaaggaggagactcccttcaacctgggaggtggaggttgcagtgagcagagatcgtgccactgcacaatcctttctatctcccttcctgggctgtgagtttctcggggcagggaaacagatcactcatccatctgtcacgttgtgatgtanactagttncctgatntatatactagtactcagaaaaatgtctgatgaatgaataaaattcatncatnnaacattttcatcatagcattggctattaaccccttgaatccccgtggctcacttgctgggtcccatccctgacccactancctggtgccgngggganaccaatttntggaggaagctctgggtacccnntcttgccctaagcctgcctctgaacaggctgttcttgtttatgacccccgtcccagcagaatagtgattgctcatccctgcatgtgatttgagagggccagtctttcaggcctggaggaaactcaagccccaccagccgcttggcatcggaatgctcagctngtcccctcctggggctcatgtgaccaagatctagctataaatatcagaggggcctcagaccaagacagaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccaggatgggaatcccatggagaacttggagaagcagctgatctgccctatctgcctggagatgtttaccaagccagtggtcatcttgccgtgccagcacaacctgtgccggaagtgtgccaatgacatcttccaggctgcaaatccctactggaccagccggggcagctcagtgtccatgtctggaggccgtttccgctgccccacctgccgccacgaggtgatcatggatcgtcacggagtgtacggcctgcagaggaacctgctggtggagaacatcatcgacatctacaaacaggagtgctccagtcggccgctgcagaagggcagtcaccccatgtgcaaggagcacgaagatgagaaaatcaacatctactgtctcacgtgtgaggtgcccacctgctccatgtgcaaggtgtttgggatccacaaggcctgcgaggtggccccattgcagagcccagggtgggaggggtcggggcccctggaggggcaatggggaggtgatgtcttctctctgctcagagagcagggactagggtaggaccctcaccgctgcgtccagcagacactgaaccagaattggaaacgtgcttgaaacaatcacacaggacacttttctacattggtgcaaaatggaatattttgtacatttttaaaatgtgatttttgtatatacttgtatatgtatgccaatttggtgctttttgtaaaggaacttttgtataataatgcctggtcattgggtgacctgcgattgtcagaaagaggggaaggaagccaggttgatacagctgcccacttcctttcctgagcaggaggatggggtagcactcacagggacgatgtgctgtatttcagtgtctatcccagacatacggggtggtaactgagtttgtgttatatgttgttttaataaatgcacaatgctctcttcctgttcttcaaag

SEQ ID NO: 89399 - DNA, 379 bp, Homo sapiens
tccagaagagagcctgactgtttcacttttaaggaacaatgctgtataaatatggccactgatacgtcaaagtgacagcctaggacttggttctaggtgacttttacttcagcttggcaaacttcaactgtcctgcttgctccttctaaaactcattttctttttttgagacagagtctcactctgttgcccaggatggagtgcagtggcacaatcttggctcactgtaaacttcacctcctgggttcaagcaattctcatgcctcagcctcccaagtagccgggactacaagcgtaccaccatgcccaggatgtacagccctcccagcacggtgctcgcttccctaatgccattccacagtatttgttgcagagaagg

SEQ ID NO: 89400 - DNA, 485 bp, Homo sapiens
cacctgctctcacctagaaaggaaattcagaagctcctgctcatcaccatcacacagtccatgagtacaaatcacccatcataagaaaggagcttgctggagaaaaggcagcaaagccttggagaatacagcagaggcaaccagcccccaccaagccagcgagcgcggtgaggactcacactgactccacaatccttctgttggatcccagccaatcatttttctaattgagtgagaaaatctgataatattgttcccctgactgaagccttcgtttcttctcatcactctaaagatgaagtgcaaagtgcttatcatggtccccaaggccccggtgtcctgtcctctgcctatatccccagctgtgtccaagccactccctgctccctccttctctacactcaaactgtccagtcctcccttcttttcctgcatctcattagcaccttccttgtgcagggctttgtgtgtgctatgcccttagc

SEQ ID NO: 89401 - DNA, 410 bp, Homo sapiens
aaaaaaaaaattaagacaatgaacgtctgtctttcatgcctctgctctctcagaagaacgagggctgtggttgaaacctaggaatgctccctgttggaagcggtggatctcctgtgcagtctgcggggcagagcctcttctcaccttccctgcgtcttctcttttttgctgctccctcacttggtggccatcccgggactgcatggagcgggtgtcagtgctgccttcactgggtgggaagtcacttttattacctccaggccaggttttccaacccgcctttccctatcctccactcccttctcacatccaccatgtcttccgtttctgaattgccccagaggataggggaggggaggaaggtaagcgtagagtagggaagagtgctgggcaggcccaacgccagccac

SEQ ID NO: 89402 - DNA, 324 bp, Homo sapiens
atggtgtatgctatatccccagtgtacggatgtaaagacaaggaaagagattaaaaaatctgttcatgcaaacaaaaagaaatttaggaatgcaacccataagatctcactcctggtctgcagtgaccacaagtgacagcttcctaggagcacgaagggcactattagtgccttattcaaccttttgacatatgtcacttgcaagtatttcaaaagccatagagttttatagatctgtccagaagtctaaaggaaaacctgccaaagacattcctcagaagagaatgtcaaatgtgttaacatagtttgcttgacaaattagga

SEQ ID NO: 89403 - DNA, 244 bp, Homo sapiens
accgggaggtgctgttaacagcagcatggctctcaactgacagataacttggaaagataaaggtgactatattccctcttctaacacagcttgaaaatctcctcctagtacgcctaagccaacatgatttggcttatacacagatcctaagaggagctaatatttttccttgagtgtccagagaatggatgaataaatgagcttgttgtgagagaccacaacacttcctattgacttccagctg

SEQ ID NO: 89404 - DNA, 281 bp, Homo sapiens
tatgaacaaaagaaggctccctggagatggtctgaaatgtaggggcagaggaagatggcatcaggactggagggacttagaagagcttgtggctctagcttcaggacttccgatgattcctccttagagtatgatcacccttagaaaaagatggtacctcttgggcctctgcactttcttgcctccatgtttgtcctcttggactggccaaacccagtcttccaaggatggaagtggatccaggaaaaatgaaagttgacacaggcatggttcagaaacag

SEQ ID NO: 89405 - DNA, 563 bp, Homo sapiens
gtggagtgtgggttgtttaccctcctgatcacgtggttgactggatgctgtggctcactgctgttgcccagcctcacgaaagggtatagtgctgcatattactagcccagaaaaagatcagaagtcaaaatttgaagtatgacttttattgaacgtgattcacttttacaccataacaaagtctaaatattgtgttaataagccaaaccattataagttgaggactgtctacacaatggattgaagggagggcaagaaaagttagtaggagactattaggagagatgcttctcaaattttaatgttcctataaagcatctgggggtcttgttaaagtgcaaattctgatttagtacatcagatacgaagcctgagaatctgcctttctaacaagccctcagtgatgctggcgattcttgtcctgagatttcactctgagcaatgagtacctggatgaaactacactagtggtggtggagatggaaagggacagattcaagacagattagagaaacaaaagcaacagagcctattgaagaagaagatgagagccatggtgaaaa

SEQ ID NO: 89406 - DNA, 256 bp, Homo sapiens
acaagaacacatggacacagggaggggaacatgttaaaagcaaactgaagccagcttcaagggactcctgctggccaaactggggacaatttgagcatcaaaataaatgactgtaatggatctaaatacactgactaaaatcagcagcaatgagtccatactgacataactaagtatataggaaaactgattagaaacagtatatttacataatttcaaagctcttcccccacaagacatttattaattataatgg

SEQ ID NO: 89407 - DNA, 789 bp, Homo sapiens
attcccttgttgcacgtagaaggctgcagttggagacgggacaactaggttctgggaagccatggcagaaatcacgcagactctgattcccgccgagaaccagcctaaagaaccactcatggcaagacgggggcccaccggctggctggctcctcaccaaactctactccgcattgactgtgggctcttgttctagaggcacccgcatcctcaggatgaaatgtgagtacaagagcagagactgccggtgctggtgtgtgcagcctctgattcaacagaaatctggaagtgttcacagcttggcccggagaagatcgttttaaatctacagctttaaaatgtggttgaaaaggagcccaggttggattctgccagcaggtccgctggccgctgttacctccccactgtcaacgcctaggtctctgcctccagccctgtttcagcctgtccttgaggatttgcttcacctcatttactgagcttgccacagattcattacctggcatcagagctcccctctcactgagcctgcccagaagggtgccagtatactagccagatgccgctggagggactccacaataaagcctggctattaaagacttcaacagtctcataaagtcactttgccagctgtagagcacacaagtgcccacagatccaagcctccttccttccccaaagaaacaccttggataaagtcttggaatatcatccattagcacatggctccagccaacacatgaattcccttacaccagcacatggtctctctttcctgttcattca

SEQ ID NO: 89408 - DNA, 748 bp, Homo sapiens
attcccttgttgcacgtagaaggctgcagttggagacgggacaactaggttctgggaagccatggcagaaatcacgcagactctgattcccgccgagaaccagcctaaagaaccactcatggcaagacgggggcccaccggctggctggctcctcaccaaactctactccgcattgactgtgggctcttgttctagaggcacccgcatcctcaggatgaaatcctctgattcaacagaaatctggaagtgttcacagcttggcccggagaagatcgttttaaatctacagctttaaaatgtggttgaaaaggagcccaggttggattctgccagcaggtccgctggccgctgttacctccccactgtcaacgcctaggtctctgcctccagccctgtttcagcctgtccttgaggatttgcttcacctcatttactgagcttgccacagattcattacctggcatcagagctcccctctcactgagcctgcccagaagggtgccagtatactagccagatgccgctggagggactccacaataaagcctggctattaaagacttcaacagtctcataaagtcactttgccagctgtagagcacacaagtgcccacagatccaagcctccttccttccccaaagaaacaccttggataaagtcttggaatatcatccattagcacatggctccagccaacacatgaattcccttacaccagcacatggtctctctttcctgttcattca

SEQ ID NO: 89409 - DNA, 392 bp, Homo sapiens
gatggaatacatctcctggagcaagagctgaagttcaatgttggcctctgagaagtggcacgtggggtgcaagggagaaaatgagacagaggatgggtgaattcttgacattctgatgtcggtaggagctgcccccctccagtgtgttctttatcctgctactagagtgacttttctacaaagcaattttgattcactgacattcaatgcatttgaattaagtgattaccttttgccaggtacaagttatatttctgcttataaactacctgtgcagtttttttcatgactttccattgccttcaggatgagagaaaaaaagtcacttggagtatcctcagtgaaactctcttactttacttttatccgtatgatttccccagcatataggc

SEQ ID NO: 89410 - DNA, 585 bp, Homo sapiens
tgaactttgcacgtctgccgaaaaatccgaacctgttgactgggatttttaagaatccgtttctcccttttgtgtattccatattggccggccccaaggatgctcgcagaagccagcccccaaccccagcccttccgtatctttcccctccatcgcggctttgcgatgaaagattagcccgcgaacagaggcattgattacaaacatgtccttggcagtggactctgggcctggcattcttcaggtttctgtcaatccagaaacgcgactttcctggacccctgcggctcttcctcccccgcccacatccagccctccaaggccagtccagaggtgaagtttgaggccctccccccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagata

SEQ ID NO: 89411 - DNA, 471 bp, Homo sapiens
cttattgatatggttcaggtgtgtccccacccaaatctcatctttaattggagcttccataattcccacatgttgtgggagggacccggtgggagataattgaatcacggggtggcttttcccgtactgttctcatggtagtgaataagtctcacgagatctgattgctttataaggggtttctcctttcacttgcctctcattctttcttgcctgttgccatgtaagtcatgccttttgccttctgctgtgattgtgaggcctccccagccacctggaactgtgagctcattaagcctctttttctttataaattacgtagtctcaggtatgtctttatcagcagcataaaaatgaaataataagcttgtattatttgatatatcagctttaaatgatatcttttgactcccagttatttaccattcaatgttctctccctgtactgttgctatggtttcttcatactca

SEQ ID NO: 89412 - DNA, 508 bp, Homo sapiens
gtggaagctgctggaggctgggaggtgctgaccatcatgttcagcaggagccagttgctgaagaaggtgtggatactctaggagccatgcgtgtttgcagcagcctgcagaaagagtgtaccggaaccaggaaggaaaactgcttctttctgtaatgtctctacagtactctccactgatgaagcttagaatggtaccagctaacaaaagaaaaaatatgtaaaggtcccttctgtgtcttcacatagtgagtaatgaagggtgaatttcgagctgtgaggcagtaaacttattgcagttcctcaaacttagaaattgggttgaatcccaataccctaatttcctgttccacatcacatttcaactaatacttgccttttatcacagcaaccaccaacaacctagctttgcaaagaaatgacatcatcaaaaggaaaataacacaatatgttaaactgtgaattcgcttgaaatagtcattcatgcaagcatctgagaaatgttgtgt

SEQ ID NO: 89413 - DNA, 664 bp, Homo sapiens
atcttgttcattattttgtcatgttttgtatagggcacccttttacaaatatcactttataaacatttgttgctattttatagagatatgatcgattttgcaattggttgtttagtttccctcaacctgccaagttctttaattaattttaatattttatatatagattttgttggattttccaggaacacaaacatataacttaaaataataagttttatctatttgcttcatatgtatgaaatattagattttttcatctattcactactcctgtgcaataggattatacaacccagaacattgtcatatgacttgcttgtgcatccctttccacccgccagtagctgtgggagggctatactttctgcatcaatgacttgatcatttgaaatggaacatggtttgggtgatatcatgtgaatgaatatagtgtgtgccatgtttgaacaaaggatttaactgccatcttgtagattggtttagattcttttgcacctgtatgtcccctgtctgaggaagaacataactcgaatggggctggtgcttaacctggggctaagaataagaagacatgtgaagctaagcacagctgtgtagaactgcaatcaacccgcaaccttcatgtcatgtaagcaagaaataagtgttgctgaaattattg

SEQ ID NO: 89414 - DNA, 259 bp, Homo sapiens
tgatggacacgctgggacatgcctgcctcggggcagccccttcggccctgggcttccagaatccgctctgaggagcctcctaggaggggccaaggcacagacacccaggggggcctccccggggctcctgactccaggggtgccgggtagcttaaggggcggccctaaccccagcagccctcaagagacttaaggttgggctgcctggaaactcacaaatagtaaagagctgaaagccggacacggtgtgggagaatgg

SEQ ID NO: 89415 - DNA, 180 bp, Homo sapiens
gtcttccaggaaaaagtctttctcagtccacactctggagactggcattagggaacctgtaccgtgtgccaggcagtgtagaatgtatgacttggaatgacaggctcttgtggttgaagagacactctccacccatgctcctgcccagtgtgggagcctcatccacagccttacagcgtc

SEQ ID NO: 89416 - DNA, 255 bp, Homo sapiens
agagagctttgaaatgttctgggaaaaacgctgatcagatgtgcaaggtattatattcacggagagaaaaaccctcccaactctttataaaatggattaagctagtttctaaaggctgcaggtttgtgtgatcttaatcccactccttactcctgatccaccaccttcctcttttgtttccaggatgtgcaccttcctgggtgagggccgggacgccttccgggggagccctaccccttcccagctctcccctta

SEQ ID NO: 89417 - DNA, 292 bp, Homo sapiens
tggggttcaccttccctgcatcattatcaactgacactaaaactcaaaggtatttatgagataataaaaacagttctaaatagaacacatttacttagagcttcacagtatagctcttaatgactgtgtgtgaaattggagatatttgactatttttcacctattctattgaagatatagcacagattaaaatgaaaattcacaaataccccaaatttcaaaaggcagaaattgaagccataagaaataatccatcaaattagacaactggtccagaaataatcaagagatc

SEQ ID NO: 89418 - DNA, 252 bp, Homo sapiens
aaagatacaaactatcaaactcctgacaagaagaaataggtaaactcaatagccatttataattttttttttgagacggagtctcactctgtcacccaggctggagtgcagtggtgccatctcggctcactacaacctccgcctcctgggttcaagcaattctcctgcctcagcctcccgagtagctgggactacaggcacgtgccaccacacttggctaactttttggatttttagtggagatggggtttc

SEQ ID NO: 89419 - DNA, 280 bp, Homo sapiens
  misc_feature (192)..(192): n is a, c, g, or t
agaccgtcttgcctgctctgttgtcccttctgcttgtgtttgggaaaagtggaagatggggaaggaggatgccctaggtgagctccacagagaagataattagtttaattactctaagatctattgtaaatcactggggagggttttaggagaaatttttggtccttttgcagaggcaggacaagcagaggnaggacaagcagatgcaggacaatcagagtcagcgataatctgatgtaacaatagtcagacgcaagacaggcataggcaagacaagcca

SEQ ID NO: 89420 - DNA, 198 bp, Homo sapiens
ggagcgagactccatctcaaagaaaaaaaaaataaataaaatgaaataataataaaattgagcaagctgagactgaccagctgcctcagccaggctggcaaatccagggctgattggatgggacatttcttcctgtagatgtcatagtcctctggaaactgtaaaaaatcaaataagcgtgaggtgataatattatag

SEQ ID NO: 89421 - DNA, 413 bp, Homo sapiens
ttaaattttaattgcagaactgtaagaaaacaaaaatggtttttaatcctaccacccacagattaacacttgttgaaataatgtcattgtttttaaactttcaattttttagctcagtgagagcatttttaattaactctctttcaaactgaacctagctgcctgtcaatatttgctcctaacaatgccagttagtaaacggactgattgtttctttcatttttattatgagacatttcaaacatatatttaaaacaaaaccagatagaataacataaacgtatcctgcttcattaactatcaaaactcagggctaatcttcttcccgtctgtaaatgagctgctttttgcatatggtacaacaaaaagaatgaggggaggtttgagcctggggaacctgccgtggcagcctg

SEQ ID NO: 89422 - DNA, 410 bp, Homo sapiens
atgttaacctgtatctgcttcttaatacaaatgcttgtatgctaattttagataatattaagtaagtggataaaaatctgaatttcctccttaaaactgtgactcccaataatcatttgcaggtggctaaaagcatattgttgtagtcttatgtttaaaaattacaacaaatgagaataatttagggaatcatcacaaagctgaaaaatcttaaaccatttcaggaactcctttccacctctcaaaatagtcttcaatgacttcccaaaccttaaaaaatggtgactgtccttagcaaaataaggcacaatgtcttcaatgttctcataagcatccacttatcagcaaatacgataaaacttttaaaagtcacccattttttacatgaaattgagaaaattgatttaaat

SEQ ID NO: 89423 - DNA, 379 bp, Homo sapiens
ccgtcacccaggaaggacacctcgtactcattagcagttacctcacacacctcccctccccagccccgacaactgctaatctactttatagctctatgtatttgcctattctgcacatttcatataaatgaaccatacagtatgtggccttttgtagctgactaattttatttagcataatgtttctaatgtccatccgtgtcatagcatgtgtcagtacttcattcttttttgtggttgaataatattccattgtatagctgtcccgcattttgcttagccattcattggttgagagattttttatttaaaatttttgtctatatgttcaaaagttgacttatagttacttcactaggcatttctcctgtttagaata

SEQ ID NO: 89424 - DNA, 379 bp, Homo sapiens
gacttggctcatgccattgtggggctggcaagttcccacagtgcaggtttagctggcaggctggggacttagggaagttgtctttgagtctaaagaccatctgctgggaacattccctctggctcaaggaaggtcagtcttttccttaaggacttcaaatgatgggatgaggcccactcacatcatggaggatactctgctttgctgaaagtctcctgatgtaaattaatccatgaaaaaacacctgcacagaaacatatagaatagtgtttgaccagatgtctgggtactgtggcctagccaaatgaacacctaaaattaaccatcacacaacacaacatttaaaccacgtcctcatacaagtttccttcctctaggg

SEQ ID NO: 89425 - DNA, 137 bp, Homo sapiens
ctggaaatggagaagctgtgttttagcatctggcataaattcagttgcttttctaccatttcaatctgttagcgtatttcttagctatttgtacccattgacattttagataagagctaagagagagttttttccac

SEQ ID NO: 89426 - DNA, 256 bp, Homo sapiens
  misc_feature (4)..(4): n is a, c, g, or t
  misc_feature (6)..(6): n is a, c, g, or t
  misc_feature (10)..(12): n is a, c, g, or t
  misc_feature (17)..(17): n is a, c, g, or t
  misc_feature (21)..(21): n is a, c, g, or t
  misc_feature (24)..(24): n is a, c, g, or t
ggangnaggnnnggaangganganagaaggcatgagttttatattgaggggaagctggaattgaatcctaggtctgacactgactagtgtagggcctttgggaagtttctcaacactctaggtcatcaccttcttcaactacaacctgaaaacaatgatgtgagccttacagggtgcagactgctaaactttttctgttaatggagcccttagtgtctcagtaattgtttaacacacccctatgccaaaaaaaaaa

SEQ ID NO: 89427 - DNA, 355 bp, Homo sapiens
aaacacgttttcactggctataaaaaaggaagtctgagagatgtgctccagctagcctaaaaggaagcaaacacccagattgtgaactgcctatggaggatatgtagcaaggatccatgagtggcttctagatgctgacaggtgtccctgctgacagctagcaggaatgaccacaagaaaggaaattctgccaacagccaatgaacttagaagagaacaccaagcccaaatgacaaccacagccctagatgacccgttaatttcagtctgatgagatcctgagtgaagtatccagtcactctgcttctggacatctacagaagcagtgagacaataaatatgtatattttaagct

SEQ ID NO: 89428 - DNA, 334 bp, Homo sapiens
ggcaagaatagtcaatactaacattgaatgttaatggactaaactctccaatcaaaactgttatggaaagaactgttatggagcagttctccccattcccacccacatcatttttcatcaactctagatgagctaagggcccccaaatgccttaggctgagcatttcttggggtgaggtcccttcttgctcagagcctaaagacaagtagtgatattgtttctgcctgtccagtgtttcctaacaggccttcagtctccagagtggagaatctgcctttgtgtggggtattagtaagaaaatctaggagccacatccaatcctctctcaccctg

SEQ ID NO: 89429 - DNA, 348 bp, Homo sapiens
acattcaaaaggttaaaaaataaatatataattcctccctctatacttttctccttcctcagtgttccctatctcaataaatggcatcactgtctacccagttatccaaggcagaaaactcaggagttatcctttatcctctttcaccctccacctccattcattcactaattcttttcaatgcatgttcttactatttctctccatctttagtgtcattactctaatccgaggcactgtcatctctaccctgagctatagcaacaactcactcacctctttccatgaatttggtcttgccccataattcactctgtgtactacagcacactcatctttttaaaataa

SEQ ID NO: 89430 - DNA, 348 bp, Homo sapiens
aatttataatctgtgtattcagagcattgatgttatagttttgatacctaaatcaccgttttaaaaattcaaagagatatatgaatcctgagtctcggacagttattcctgagccaaaggatttctgtgcaatgctaatatgtataatagagaatcagtctttcactgtacagttttgtcatcatgtttcaataactgaatgaatattctgaattaataagcataacgtttgtataagctaaagactaatctaagctctgcattcattgatgggaaccttaagcaaatgtttcttttcatcagcttgttcaaaaggcataaacataattacagttctgaggcgataac

SEQ ID NO: 89431 - DNA, 224 bp, Homo sapiens
aacttttgcactttgtctaccctgaattccagttactatggcgtaccatgtcttaccttcctggcttgtcttaggattgtatttgggggcctgagttcataattaatatataaacttgtgattttagagataattttgaccggggctaagttttttaaggaaaagaagtgagctgcttggaagaataataagctggcaacagtgtaattgatgcatgggcatgg

SEQ ID NO: 89432 - DNA, 469 bp, Homo sapiens
gctgcacagaggtggaccaggtaaatgagttaagacctctgctgcgagaagctctgcaatgtcagaacactgagtaaaaacaggagctctcacagcttaatagagagagggggaagaaacaaacaccaggtcatccacaaaggaacaaggctgggatagacatcagacttttcctaagtcacactggatcctgaagacaaaggaacagggccttccaagttaatgtctcacacactccagctaaaatgagataaaaccaaggagctagagacatgactgaatagtaaagggccattgcatgacaagagtgaggcagagaccccgggaggtcactggagcacaggaccaagactcacgggggaaaattccaggaggaaagtgagttttgtgcaccagagagtaccatcaaaaggctgggtaaacttcaggacccagtaaagacacaccactcttctttgtttaaaagaaa

SEQ ID NO: 89433 - DNA, 1254 bp, Homo sapiens
cttggttttatattgtttttagatcagtgcttcaacatccaggctgacgtttagccattttggctgctgttctttaatcttcctctagcaggcatgcagtccaaggaatatcaaaattctggttgtattgggaaccaaggttactttcttgtttttggaaaaacaaaatttctacaattacagttcccaaagtcagttattcatgttttcatttaaagttttatccaatattctaggaattttcagcaatactgatattcactttattttttttctttttttaagacagagtcttgctctgtcacccaggctggagtgcagtggcgcgatcttggctcactgcaagctccgcctcctgggttcacgccattctcctgcctcagtctcccaagtacctgggatgacaggcgcctgccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccactgcacccgaccgatactcacatttttaaactttttttttaattttattttggtagctaggttttatattgttcttaaatttattttactctattttatttttccatcacttctttgtcccagattcatgaaatttgctgatgtccattttatgtctacttttgaactcttctctttgtgtttgttttgttcttattacaaactccaagacatttcttagaattgtctacagatttcgtgtagctacttattggtagcttcttaatttcatacttgtccagaccattagacattattacatgctctgtcttgggcctatcattaacattagcttagggattctgatttcaaagacataaagaattggcaaaactcttcttacagaacttaaaacaagttttaaagttacatttctatacatctaatacataataccttcttagccattaatgtaattcctctggataaagataatatattcaaaaaatattgggaccaaaaaatgcacttgtttcttgctcatatatatatagatgtatattttttttaatttcttgtttgtttattttggttacattgaatacagatttgctgaacagttttgatgttatttttttaataaaatttgtattgttaaagtgccttggaaatttctaataaataacttcatataaaagctatcatataactatagga

SEQ ID NO: 89434 - DNA, 415 bp, Homo sapiens
cagctttgagctaatctcctcgggcaggtcaaataagggtgtgtaggcacaactcctctaagagcttattttagttactgtcttcttgaattgctttgctggtaggagggttaggcaacacctcttctagtcccctggctgtccttggctggagttagctgatggtagactagtggcagggttgtggatatcccaacaatgccacaaagtccctttctggttgtatctctccatggagccaacataaatgtaaatcagcagaaaagtgtgcagatgagaagatattgtccataaaatacacaccaatggatcatttcagctacaccagaagaaaggaaatgtgttttttctagaggataaaagagaaaagtagccatttaatgagggaataaactacctgaagggtatatacatt

SEQ ID NO: 89435 - DNA, 568 bp, Homo sapiens
ggtagagatggggtttcaccgtgttggccaggctggtctcaaacttctggcctcaagtgattctcctgcctcggcctcccaaagtgctgggattacaggcgtgagtcactgcacccggccaatttattttctccttttctcaacaccaagctcctgcaggaggctcctggctgattttcccatcttcttttccatactacagctagagctatctcagtttcatcaaaatgtcaagttatgacttacctgcttaaaatctccactggttccttcttgcctaaaggcagagtggaagcttagtcctgcaataaagaaccttcccaaattccccagatttgtgaagtaagtttcctactttacaggcttcacctctggcaagttgtgctgctcaacatcctttaaacctggtgttcttgtgcttgtgcccaaacccgtgctgtctcctctgactggagtcataataatagcagtaatagtagatactcatggaccactttccctgtgcctcacagtgtttctgtgcaatctgcatggcttagttcactgaatcctcctgccaactgtgtga

SEQ ID NO: 89436 - DNA, 2681 bp, Homo sapiens
  misc_feature (355)..(355): n is a, c, g, or t
ccacgcgtccgccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgangcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtgagtggcccaccagagcctccctcagccacgcctctctcagcccaggtctcctgggcatctggccctgctgccccctacccggctcgttcccccaggggtgagccccgccgtgtctgtggccctctcttaatgccacggcagccaccctgccatggaggcgccttcctgggttggccagagggcccctcactggctggactggaggctgggtggccggccctgccccccacattctggctccaccgggagggacagtctggaggtcccagacatgctgcccaccccctgctggtgcccacccttcgcagttactggttggtgttcttcccaaagcaagcacctgggtgtgctccaggcttcctgccctagcagtttgcctctgcacgtgcacacacctgcacacccctgcacacacctgcacaccgtccctctccccggacaagcccaggacactgcctttgctgccttctgtctcttgcataagcctcaggcctggccctttcacccctcttcccaccaactctctctgcccccaaaagtgtcaaggggccctaggaacctcgaagctgttctctgcttttccattctgggtgttttcagaaagatgaagaagaaaacatgtctgtgaacttgatgttcctgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtatttttttattggtgctg

SEQ ID NO: 89437 - DNA, 2050 bp, Homo sapiens
  misc_feature (327)..(327): n is a, c, g, or t
agagatgtagggcgccccttttagctgcgcacagaacgaaagaactcgttttttctttaagtgagtgtgcttgggtgacgcttagggcgccctccgcagtgcgcgcaggaaagcgcactgaggctgcggaggcagagctgcatgctgggtgcgggaagaggtgggctccgtcgcggagtcgctgagtccgtgcccttttagttagttctgcagtctagtatggtccccatttgcccttccagtcccggagccgcgtgagcctgcggggccatggagcgcgcgccgcccgacgggccgctgaacgcttcgggggcgctggcgggcgangcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaaaaagatgaagaagaaaacatgtctgtgaacttgatgttcctgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtatttttttattggtgctg

SEQ ID NO: 89438 - DNA, 2413 bp, Homo sapiens
  misc_feature (327)..(327): n is a, c, g, or t
agagatgtagggcgccccttttagctgcgcacagaacgaaagaactcgttttttctttaagtgagtgtgcttgggtgacgcttagggcgccctccgcagtgcgcgcaggaaagcgcactgaggctgcggaggcagagctgcatgctgggtgcgggaagaggtgggctccgtcgcggagtcgctgagtccgtgcccttttagttagttctgcagtctagtatggtccccatttgcccttccagtcccggagccgcgtgagcctgcggggccatggagcgcgcgccgcccgacgggccgctgaacgcttcgggggcgctggcgggcgangcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtgagtggcccaccagagcctccctcagccacgcctctctcagcccaggtctcctgggcatctggccctgctgccccctacccggctcgttcccccaggggtgagccccgccgtgtctgtggccctctcttaatgccacggcagccaccctgccatggaggcgccttcctgggttggccagagggcccctcactggctggactggaggctgggtggccggccctgccccccacattctggctccaccgggagggacagtctggaggtcccagacatgctgcccaccccctgctggtgcccacccttcgcagttactggttggtgttcttcccaaagcaagcacctgggtgtgctccaggcttcctgccctagcagtttgcctctgcacgtgcacacacctgcacacccctgcacacacctgcacaccgtccctctccccggacaagcccaggacactgcctttgctgccttctgtctcttgcataagcctcaggcctggccctttcacccctcttcccaccaactctctctgcccccaaaagtgtcaaggggccctaggaacctcgaagctgttctctgcttttccattctgggtgttttcagaaagatgaagaagaaaacatgtctgtgaacttgatgttcctgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtatttttttattggtgctg

SEQ ID NO: 89439 - DNA, 358 bp, Homo sapiens
ttgaagcattctttgaaattttctgtacatttgaaaagcaaaaatctggaaaaaaggaaatatacaactgaaagaagagttcattaaaaacagaaaataacaacataaaagaataattagaatcacttaagatgaattttaagaaggctttagtttactacttaagaagccaaaaataaattcagttctttaaagagttgatattgcctatcaatttttcatacagacctcctctcctagagttataaaatatttcttcctactgataataggtactgctctcagaacagccgaatcagtcagcttaattattcaattatggattcctttcatggagcatgtaacacctccctttatt

SEQ ID NO: 89440 - DNA, 413 bp, Homo sapiens
atggggtttcaccatgttgaccaggctgatcttgaactcctgacctcaagtgatccacctgccttggcctcccaaagtgctgggattacaggtgtgagccaccacatctgacctacttgaaaattcttaaatggtgccttatactttctggtaataaaagcactattttaatgttcggaactattttcattatttgctaaccttacaattaaaaaatccttttatatttatctttggatagatatgaggggacctcaaaaagtttgtggaaaaatggaattaaaagataaaaatacaaaatataaactttattctcaatataagctctatcgagttcaagaaaattttgtaagcaataatgctagccatttagtccactcctaaagaagtcctgtaaccatatcagtatgtgc

SEQ ID NO: 89441 - DNA, 426 bp, Homo sapiens
ccaggctggagtgcagtggcgcaatttcggctcactgtaacttctacctcccgggttgaagtgattctccttcctcaacctcctgagtagctggattacaagtgtgcgccaccaggcccagctactttttgtattttttttagtagagatggggtttcaccacgttggtcaggctggtctcgaactcctgacctcgtgatccgccagcctcggcctcccaaagtgccgggattacaggcgtgagccaggcgtgagccaccacaccccagccacctcctactatcttaacagagagttggctaactataaactccagtggggcacagtaaactgtgcctgctgtagtcagccagaaaaatattgctaaataagcaatttgtaaatcaaataaaatcacgaatgaaaaaaactcagaggttaattcat

SEQ ID NO: 89442 - DNA, 441 bp, Homo sapiens
gcttgaagagcagacacatttgtgcagctatcccctttgttttatgatgtaaatcttgtttttaggatgagtgcttatggggcattgttgaggggtattacaattgccatctgcacccaaatagcccagatactgaattgccttaagatgccttagactttcaccattttaatcatttatttcattaatgttatctacctaaacccttatttttatttatttatttatttatttatttatttatttatttatttatttattttgagacagggtctctgctgctcatgctggagtgcagtggtgcgatcatggctcactgcagctttgactccctgggctcaagcgatcctcccacctcagactcctgcatagctgggaccacaggcacgtgccaccatgcctggctaatttttgtattttttgtagagatgaggttttgcc

SEQ ID NO: 89443 - DNA, 231 bp, Homo sapiens
tcccagttccagttaagtccccagattaaaccaagggcttcacagaccaatcaccaagtattgcttgttgaaggaggtccaaaggagggctcagactagatgggaacagtctggaatcagaaataatctgaggctgggcgcagtggctcacgcctgtaatcctagcactttgcatggccaaggcaggaggatcgcttgagtccaggatttcgagaccagcctgggcaacat

SEQ ID NO: 89444 - DNA, 190 bp, Homo sapiens
cctctgacttccaacctctcctccatcctcctcactcccagcttgtgcccgttttccccttcactgagaaaaaagaagcttccgaagaacttccagagcctcccaccacaccctctgcctgccagcagctgatcccgttcctccagatgagctatctgtgttcccgactacagccagccgtgcctccgtg

SEQ ID NO: 89445 - DNA, 313 bp, Homo sapiens
ccgcctacttctgaaagacacaggtcactgtcagaaagcccaactgtgctgtggccttccctccagccgcccccgtggggcatgtggggtgacagtgtgagccgtcctctgatgtctggctgctagagaggcaaagaacagagacccgaggttccggccacctttctctatgaaagggccttccttgacgcttctccaccttcctgggattgttttcttctccagtccccgaatgggcaggcctgtatataagccttgtttctagaaccagacaaagctggatttgaaacctggcgagccattgaacagctat

SEQ ID NO: 89446 - DNA, 480 bp, Homo sapiens
tcaaataagcaggttggcagagtcttcactaagcagcatggtgatctacaccacttgtatttaatgaaacattcattcagtcatatcagataggagagtttaattttgggccaatatttgtttttttaaatgttgtgctagtaatatagtaaaaccatggcatattagaaaagtattcttttggaaagttaattatagtttctttgaatacaaaatgaccttcttcaaatgccttcattatagctgaaggtaaatgatatgtacatacgtgactgtttcttgttactcttgtaagagagagtattaacaaataggaaaaatgaaagaacttaaggcccaaggaaaagcaccatgcttatggtaatagggtgatgaatcacgtggctaggctgactccttctctgttgtcatcctagcctatcaatcatcatcctacatttctgaccccttcctacttaaatactgaattttgcatttgcc

SEQ ID NO: 89447 - DNA, 1065 bp, Homo sapiens
ttttttgagatgcagtctcactctgttgcccaggctggagtgcagtggtgagaccccggctcactgcaacctctgcctcccaggttcaagcaattctcctgcttcaccttccccagtagctgggattacaggtgcacaccaccaagcctgactaatttttgtattttagtagagacagggtttcaccgtgttgcccaggctagtttcgaactcctgagctcaggcaatccgcccgcctcagcctcccaaagtgctgggattacaggtgtgtgccaccgtgcctggcccaattctgcatttttaacaactcccaagtaatttagctggcctatggaccacactttgagtttagcaaggcaagcttttttatatacacgctaggacaagctcctccttgagaaaattgaaaattggaggggagtacatatcagcttttttatttgtaaaacatgatgatggagcagaaacaagtaatttgttgccttcaaaaaccagattgggagaggaaatgtcccatacctgcaggatcatggattttaaaattgagggggctgattctaagagcaaaataaagatagagagaagtaagtgtatgtgggaggagaaaggggtggtgaccgtatggagaaagagaatatgaatcagtgatgtaaaggaaaaagttccataaaaataattattaaaaacataaggcccatcatttagcaagtaatgacagttggatggaaagagagtaaggcttagggaagggaaaatgtgccagaacaggacctcacaacccaaaattactctaccaaatgagagatgtaccttaagcaaaagggaaagatgcctgggttctgtagaaagacttttcagcacagtgttaaaatcttttttttttttggagtcgaggttttgctcttgttgcccaggttggagtgcaatggcgcgatcttggctcactgcaacctccgcctcctgggttcaagcaattctcctgcctcagcctcccatgcaccaccatgcccagctaatttttgtattattaatagagatgtggtttcaccacgttagccaggctgg

SEQ ID NO: 89448 - DNA, 502 bp, Homo sapiens
gacacatgacaacacacactggagagaagccctataaatgtcagcactgtgggaaagccttcacttacccccaggcttttcaaagacatgagaagacgcacacgggagagaagccctatgaatgcaagcagtgtgggaaaacattcagttggtctgaaaccttgcgagtccacatgaggatccacactggggacaaactctataaatgtgaacactgtgggaaggcttttacctcttccagatcattccaaggtcatttgaggacgcacactggagagaaaccttatgagtgtaaacaatgtgggaaagccttcacttggtcctcaacgtttagagaacatgtgagaattcacacgcaagagcagctctataaatgtgaacaatgtgggaaggcttttacctcttccagatcattccgaggtcatttgaggacgcacactggagagaagccttatgagtgtaaacaatgtggaaaaaccttcacttggtcctcaacgtttag

SEQ ID NO: 89449 - DNA, 455 bp, Homo sapiens
  misc_feature (217)..(217): n is a, c, g, or t
gttttatgaagtagttagttttcaaagtacatcttttcatgatatatttcatacactgactttaaatttgtgtatactacaagaaaaactctccctcaaattttaggagaatgcataagtaattattaaaggctttctttcttactttactcaggaatgcaaatttatatcctttacttgtctggaggtgagtgaaactgaaaagcaggtggagggnctgaactgttacacaattccaagggccaccattaacactgtactctacatttgtattccaggaggcaccattcacacagaatataatatgaatactgccacctaaatctgtagaactcaaaagaactgtggagagaaaataaaacttaccataaacttctgtcagtgaacctagcagctaaaaaatatttcttctaaaaataaatacaagatagtcaaccataagtaagtagatttgg

SEQ ID NO: 89450 - DNA, 570 bp, Homo sapiens
gcagcattctttcctggttttaataaaggaagataactatacttcattgatcaattaatatgggtgaagccctttgcattacatttattgtactacaattatctttttccaatctcccctttcctgattttaagatccttgcagaaagggggagcacatttttgttgaaggaatgaataattagaagaatgattactctgaactagccacattcacttggattattcccttcctaaaacatgattataagtcaacaaaacagctggcccgagttaaaagtttcctagagcctttttttctgtacaattccagtaaactcacataggaggaacgcatgatgtcagcctcttcgttttccttttttttttaatttttattttactttaacttctgggatacatgtgcagaatgtgcaggtttgttacataggtatacatgcgtcatagtggtttgctccacctatcaatccattatctagagtttaggccccacatgtgttaggtatttctcctaatgctatacctcctgtagcccccaagcccccgataggcccgggtgtgtgatgttccc

SEQ ID NO: 89451 - DNA, 322 bp, Homo sapiens
tttccagcttcctcccattcatcacccccaaacaatttgaatgggcttaacacacattgagagtgattatttttatgcgttgaaatttaaagagatctcttggttccttagaaagttgaggtaatcacctttaagggcacaggaatgtaatcagtcattagcttgtaactgaccctcttgcagtgggtttgtatgtgtcatgttcccaagagaggctagtgtcctctagtaactctcagctctttgaaaataacaggggggccaggcatggtggctcacgcctgtaattccagcactttgggaggccgaggcgggtggagca

SEQ ID NO: 89452 - DNA, 374 bp, Homo sapiens
tgacatgacacttttaagctaggtgactttgagtgagttatttagtttaagtgtctctttctttgttttttaaaaaagatggtttccatatggttgtcataaggataaagataaataattggtataataaagcacataaagtgcacatgagttggaggtatcaagtaaacagtaaggctcactgtagcacatctggcccagcagcccacagatccagatgctgcacactcctgggtgctcacactgtttttcctggcacacaaaacagagtaagcatctctttgggttccttccaacattttactcatacaaaagatagtggacaagagagactactaagggtttcattagggtgcttaaatcatatatctcac

SEQ ID NO: 89453 - DNA, 336 bp, Homo sapiens
gtatttggagacgggacctttggaaatgctttgattaggaagaaggagctttcatgaacgggattagtgcccttataaaagaggacgcagagagctctctcacaccttccactgtctgaggacacagggagaaggccctgtctatgaaccaggaaatgatccccaaccaggacaccttgatcttggactgcccagatgctccagatctgtgagaagcaaatttctgtgctttataagctatccaatgtatggaattttggtacagcagccccaacagactaagatattaataaaataaagatataagatctctgttgaaatgcacaaataatatct

SEQ ID NO: 89454 - DNA, 632 bp, Homo sapiens
catgatacgaatcgagctcggaccggaaaggtagctgtactgagatactttggttttacatttgtttagctgagtatcaaattttgctgcctcttagctctcatgtcatatacacaatgtctctttaaacaagagaatgcaacagttatttttccttttgactattaaactgaataaccagagttatagcagggtagaagagaatgtagaacttctcaccttttactttcttagtgcctgtgaaagtgctaggtttcacagagttattttgttgaggtatgtcatagtgaaacaatggagaatgcaaatgcaaatacattaaaatttttagccagtaaaaccttgtttttaaactccaaaaagagaccatctctatcctgaataattgttgatatttcaagaaaatgattattgtctgaaatagtttttttattggagacctagtttattttacaagcatctatctctgcaacttttattctagttaaaagaaaaacttgaggccaggcgtggtggttcacacctgtaatgccagcactttgggaggctgggatgggtggatcgcttgaggtcaggagtttgagaccagcctggccaacatgtcaaacgccgcctctactaaaaatacaaaa

SEQ ID NO: 89455 - DNA, 505 bp, Homo sapiens
gccaagatcacaccgctgtactccaccctggatgacagagtgagaatctgtctcaaaaaaaaacaaaaaacctccaaactcacacaatcacgacgaactcatcacaccttctctgccaagaatatacagtcctctattattcgtctaaattctaatcatcctttagatctcaaaaataacttttcccagaaaacattcattgaaccttcaaatatgatagattgtattagtttctaactattcacctcctttccataagaggatttttacatctccacccactgccatgtggcttgtctacaaggtccctgaagaggaatgtacctcccctcttcattaacatcaagcttgaccccgtgactggtttcgaccaatagatgtgagcagatgtaatatatgtcacttcccggaagaggcttaaagtcatgatgtcttctagctctttctttgtgccactagcaaactagcaagcaagacatgtcacacacagggtctgcccctccag

SEQ ID NO: 89456 - DNA, 169 bp, Homo sapiens
acaaaacatgaaaacaaattccacatttccagctattcttgagaaattagagatctggccatgctgagcccttgttcctgcatagtaacgatttgctggagctgcatgatgaccaccccctttactgtccagtttatccaagatcctgcttcttgtcttattttgggcc

SEQ ID NO: 89457 - DNA, 259 bp, Homo sapiens
atgctccatttcatgtttcaattacctctgccatctccatgtcttccagactaatgaatatgtccagcatggaaacgattaattttgttagctactttatcctcatgggctttccctcaagcccagaaatgcagctcctctactttggtctcttctcattagcctatactctcaccctgatgggaaatgcatccattgtctgtgctgtgtggtgggaccagcaccttcacactcccatgtacaccctcttgggaaattt

SEQ ID NO: 89458 - DNA, 364 bp, Homo sapiens
tcaaaggacagtgactaaacctctgaagagggctggaagcagcaggtgcctcccagcagcccactttctgtggcctccataaagtggttcacaactgcctgtacttgatgtccactgttcactcacgcatgtcatgggatccaaataccacggtttctctcccttgcccctttctcttgttgtatcccctgctctcatttcacttctatcacttctgtcaatttctttttattttctccttattagttttcctcttatctttcttgcagaggtaccatttgtagttcctcagattccatttgttcattgctagtttatgcttcttttcctcaaaatcatctttttttctcgcttgtcaaataca

SEQ ID NO: 89459 - DNA, 892 bp, Homo sapiens
ctcaggcttctggaagaactggtcccaggaattggaaagccatcagcaatcctgagggtcctttctgtttatgtctttctttctgcaaagcttttactcatctttcttactaactggctttctctgccactctgtcggtagagggtggcctcccacagccctaaactatgcagccaagttctagccaaatggaaagcctgtctttccatctcaattctaaattctctaagacttgggctaggcttgggttagatgtctatccctggactagtcagctgtggccaggagcggagacatgctgcacatatctgtctgcctctgctcacctccgaaaagtaggtgggaagatagaaaaaggggtagggaggcagcagacagagagacagacagcagagagacattgtaaggctggcagacaccttataaatatctaatatggtgagtctccataaactactacccttaaactatatcataggatcacttctaggttattttgttaaaaaaagtcagtcctaggtgaaacttaaaaaatttaactttaaaaagacgatatcttttaaaatatgcatataatttgagactcttaaggtaacgggatattcactatagttagtaagtcttagctttgtgtgtatatatgatttttatgcatgacactctttaattgctgggaggttctagcagctctgtccagcagaaatacaagataagccacatttgtaatttaaggttttctagtagccacattgaaaaagtaaaatgaaaaaggtgaatttaattttaatgtattttatttaaccccagtttcccagatataatcgttatatgaatataaaattaatgaaatgttttacattcttttaaaaacctttgaaatatggtatgtatt

SEQ ID NO: 89460 - DNA, 823 bp, Homo sapiens
cggctcaccacaacctccacctcccaggttcaagcaattctgcctcagcctcccgagtagctgagattacagcatgcgccaccacgcccggctaattttgtgtttttagtagagtgagggtttctccatgttggtcaggttggtcttgaacttccgacctcagttgatctgcccgccttggcctcccaaagtactgggattacaggcataagccaccgcacctggcctggttgcccattctttatggtcgtttcttgatgatatgctaaccaaggagtggattaatcatgcctcccctttttggaccacatagggtctaaactgtcatggcacatttgtaaactgtcatggcactggtgggagtgtagcagtgaggacgaccagaggtcactctcgtcgccattttggttttggtgggttttggccagctcctttactgcaacctgttttatcagcaaggtctttaagacctgtattttgtgctgacctcctatctcatcctgtgacttagaatgccttaactgaccatctgggaatgcagcccaatagatttcaccctcattttgcccggctcctgtttaagatggagttgctctggttcacatgcctctaacaaatccttttagtttttcatgcttgtcacatgtttacttctaagggtataatcatgtggtttactatattattaccgattagattattttgaactacttcaattttatttattttacctcatttccattcacattttttgaaaagagcttttttatacaagagtgtaaatattttcacattgaataaatgaattgaaaacagtaaaaat

SEQ ID NO: 89461 - DNA, 1082 bp, Homo sapiens
gccgagaggccaggcctgtgcctcccaaaacctgctcctccgcaggcttccccggcccatctccagagcgccctcctctcaccactttacataaacgaatgtacccaagatcccccatcagttttccatgcagctgccagagtgccaccaaagcaaacctcatctcaagactctgtggccaggccctcacaacctcctgccaggctctcgctacctacccatcaacagcaagactcccaggccatctcaatccccccaaagagccctgttcctccagccccacggcttctgttcacctgccgtgctgtccccgcctctgcccacccactcatcctgcagatctggagcagcattccagggcctgcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaa

SEQ ID NO: 89462 - DNA, 902 bp, Homo sapiens
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaa

SEQ ID NO: 89463 - DNA, 1390 bp, Homo sapiens
  misc_feature (950)..(950): n is a, c, g, or t
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaaaaaaaaaaaaaaaaaaaaaaaaaaaaaaaaaaaaaaaaaaaaaaacanaaagaaaaagaaaaaaaaaaaaaaaagcgacagaagacccaaccaacgacacacacacgggaccaccacaaaacgagcaacacaggagcgagacacaggaacagcaaaacacaaacaacacaaaagaacagcaaagaaaaacacaaagaagaaacaaagaacaacagaagagaagaaaaacgcacgaaaaaacacaaaaaaagacaaaaaaaaagacaccaagacgcgacgaagaaaacacagcacacgcggcagacctctgtgtcttctctacaaagaagagcaggaaaaaaagaagacagcaaaagcagaaagagaacacaagacacagacgaaggaggcacgcaggaaggagagcacaagcagccaacgccacacgcggcagaggagaacgaacaaaagaacagaaaggacacgaagacacgcaccgcgggcgggta

SEQ ID NO: 89464 - DNA, 963 bp, Homo sapiens
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctgggcaggatagcctgaggcacgcttgcttcactcccaggcagaatggccactgagaaatccggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaa

SEQ ID NO: 89465 - DNA, 680 bp, Homo sapiens
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggcccttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaa

SEQ ID NO: 89466 - DNA, 746 bp, Homo sapiens
ggagagcgggcattctggaaagcgtgggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaa

SEQ ID NO: 89467 - DNA, 388 bp, Homo sapiens
gtggaggttgcagtgaaccgagattgcgctactgcattccagactggatgacagagtgagaccccgtttcaattaaaaaaaaaatctggaagtatgagtcctccaattgtgttgttctttttcaaattgtcttagctattggggatgtctcacaagtccacattaatttgaggattggcttttccatttctatgaataaagctattataattttgatagggattgtattgaatttgtagattgctttgaggagtattgtaatttgacaattttaagtctttcaacccatgaactggaatgccttgccatttatttaggtcttcttcagtttctttcagcaacgttttttagtttttgtataaatcttgcattttttggctaaatttat

SEQ ID NO: 89468 - DNA, 312 bp, Homo sapiens
tggaaaatctgttagatgggtttacagtttttatatgttcatgacaaattgacctttttattattataaaatcattgtcttagtccttagtaactttttttgcttttgaagtctattttgtttcacgttagtaaaaccatttaaagcctcttcttagaatggtatatcttttactgtcaacccatttttttatctttgaatacaaagtgtgtcccttctagactgcatatagcttgaacttgcttgtcacagtctgtgcccttttattggaatatttaacttatttatattttattttattttttgagatgg

SEQ ID NO: 89469 - DNA, 321 bp, Homo sapiens
tagatatgatggctggagctgcaatagctaacttgcaactatgaggaactataggactttggtcttaacattcctgagctcctgaatcaatactttaactaccttctatgagacttcttgtcacatgagaaaaattaagccccaaattaaacccctgccttttactgtaactctcaattgagcataattcctaaatgatttaatcaattctactctactctggcatgatttttaaggcattaaccataatttccttccaatctaaaaagaaactaatacttactgagtatctagtatacatcagatactgtgtatatagac

SEQ ID NO: 89470 - DNA, 378 bp, Homo sapiens
cattgccccactcctgttagcagcaaatataagacttgggctatgtgtctgaactggtcttgggtagtctccatttcacagactccagtctgaattaagcatcaacctgcttgatctttttccataagaagtagtaaccaacattgaattgcactatgtgcttcacatgtattcatctctcactgtaaacccacacatttggtatagaattatccttgtttacagacgagaaaacaggaatagagggaaaataaattgccttgagtgcatgcctctaaagctgatggagctaggattcaaatccaggccacaagggctactttggatcctccctctccatcatgcatataccacaccatccttcccatgcagctcatc

SEQ ID NO: 89471 - DNA, 396 bp, Homo sapiens
gcttttcttcatgcacttattcttactttgtcttctaggtacttaggtaagcttccttgcgagcaataaataaataagttgataacaacaatggttaacagtggacctttattaggccaggcattagccagggtcattgtgttactttcctatggccactgtaacaaatgaccacaaacttggtgaattaaaacaacataaatgcatcatcttatagttctgcaagtcaaaagtctgacatgagcctcacaggactaaaatccaggtgtggacagggctgctttctcctggaggctccaggggagaatccattttcttgccttcttgtgcttccagagactgcctgcattctttggcttgtggccacttcctctgtcttcaaagccagtactggca

SEQ ID NO: 89472 - DNA, 348 bp, Homo sapiens
tgattacctccttaacagagtacctgcctcctggtagttgcagctctttattctatgccatagactcagaagtcttccttatttgtaccatggttacttttatccttctcagaagtcacatagttcatattaaatacataaaatctaaatccgtcacctttcatcccccaccagtatgttttgctaccttgcctatttctcatttctacccttgcctattagaatccaaaggatttttaattgctcaggctggataccctaattagtttagtcttttatttcaacccaggttgttttcttcctatgagaagtagcttagattttcttgccttttaacttctactggtg

SEQ ID NO: 89473 - DNA, 596 bp, Homo sapiens
tggtggtggtggggtattttttggagaaacgagttctcaccatgctgcccaggcttgtctccaactcctgggcttatgccatcctcccgcctcagcctctcaaaaagtgctgagattacaggtgtgagacaccatacccagctatatattttatttctgtaagttctatttcatccattttcctttcaggtcttcctcatcattcctggtggtcttactgctcctgctcgctcaattttatgagtccatctttttcttatataatacatttatttcacatgtaactattttctcacaattctaatatttgaagtctgtattctgtatctgataattccaaaacctacagtctttgggaaacattcattgtttctgataattctcaaatatattgggttcactacttgaatgctatgatttcactgaattcatagttgcctgcttttaatctttgggaatcctacaggcttaagttagagatggtttcctagaaaaagtatctgtgcgtgcttctgatgagagctgtggggacaactaacaagagacccctttaccaccgtccgtaatcctgatattctcttggattctcctggaga

SEQ ID NO: 89474 - DNA, 503 bp, Homo sapiens
aacaaaatttcctgggaataaatgagccctactgttataaaagtttaaaaattattacagatgatatgccactaagagaggaggtagcctacagcactgactctcccctaaggaagacttcgttcttagaaggggaagaaggaaactgagaaccaagccaccaagcccagacccgaaatgagtcaaccagaggctcaaaggctgcggggtgggtcagcacgagacgtttgcaaagcagctgggcccaagacccttgattggcagaggcgttgctaaggcaaacagtgccgcttcctcccattggccagtcagttaagtgccacccggaaggtggagctccccagacagcaagggaggaagccccaccccctctccttaccgggaaaaggaagggggaggagtaacagcgcaggcatccctagcagcaggcaaatgcgctccctaactgcccaggcccccaacaccctgaaagggcagcggctggcttgtaaggtagtccccgg

SEQ ID NO: 89475 - DNA, 256 bp, Homo sapiens
agggtgactctcaggatcttcgccgactagcccgagcaggcctggtcttagcaagaactgtgctaagtcaattattagcacaatcttcccacccttgagacctgatcaaattcctcattccccacctttgatgtatgtgtccttgacctgtctgtagcaagcatcctgttaggtcagtttagcaagaagcccctatccttgacatgtcctcttggtaattttccacccactgatcccctgtcactctgcccatagg

SEQ ID NO: 89476 - DNA, 411 bp, Homo sapiens
atagcaaagatgcctctgctgtgtccttgttctctctgcaagctttttaccaggtgctggactggagacttgctgagtgctagaccacagtgatttggtcatagctggatgtgaagatggctggctgttctttcagaagggacctggctggagttcttattgctcaaagctccagcttgcagcactgggctagagctgatggaaggagagctgttactattctgttctacgtgaatgctacactgtgaaagaacagcatcatccgacttgggcaacaagatagtattcaagatgtcttagaaggcctaatcagaacttaccagctgtagcatagcactccctcaagtgcagatgctggacctctgcagcagaaattactcaagctgttcagtataatagaaatgaaaattc

SEQ ID NO: 89477 - DNA, 825 bp, Homo sapiens
gcgcgaagctgggcggcgccccgagggcggaggacaggtggccgcgcgaccgcagccaggtagcgaacggctcgggggctgcgcagcgcggtcccaaagctcagcccggccccgggcccagctcgctgccgcctgccacgggagcggccttccccttccccttccggctcagcccgctgccccagacgtgacccccgcggaaggtgttggcgatgcgcgctgcccgggagcgtgtgattaatggccccgaggtcgtgggcggcgcatgcaccagccccttcttggcctggtcagggtgtgagggtatccgggagcacagcgaggtcatggcagcgggggcctccgggagcgcggcggcggaggaggaggaggaagaggagaagtaggtgacgcgggccgaagaggcttgtcccctctggccccagggctggcgccgcggcgggtcccccgccccaagcaaagtttggggctacgggcgctgcgctcaggtccctccccgcgcagttccctcggcggggtctgtgccgccgccgctgccagggcaggacaaaggctcattaacacgtgatgggaccgcgcttcataaatgggactggagcgagagggagccagagacagcgcgagcggagggagcggcagggactgcgcgagcgggacgaggcgacgggcgcccgggctggcggagacgggcggccccacgccgggccaggcggggctcgcgggaggacccagtgaagagcctgggaaggggcgaggctcgccggcggtcggagcagcggggcgccagtcccggtcgctgtcgcgggcgggcgctggagaccggga

SEQ ID NO: 89478 - DNA, 382 bp, Homo sapiens
acacccctggtccagactttccacatttctggtgtgaactattgcaggaacccctatgtggttttcttgagtctagtgtcttgaactgctaatccacagcagagatattcccaaagagaaagatctgatcatgtcactgcccaaatgaaacaccttcattattttcccttaaatgacaatacaggacaaagtgtaatcatctcaacctgacattcacagtctaacttcccaatttttctcctgttactttaagttctagtcacatcaaacttcctactggtctgtggagattctacgtcacacttctatgctttttcacatactgcctaaaacgttgtttacctttttccacctggatctcctgcttgttgctctacaccgg

SEQ ID NO: 89479 - DNA, 657 bp, Homo sapiens
cagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgactttggggacgtccctatagacagtgatgtgcatgtcagcagcacacgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggattt

SEQ ID NO: 89480 - DNA, 519 bp, Homo sapiens
ccaaatagaggtagccttctgggccattaaatccttttgctttggattaatcccacagtgtatatcagatcactagaattcagatgaaaacactgctgtagtactcagtctcctcgccaaatgattccaaaatatataggttataaatacagaaaaaataactgaattcgatatttcttaagtgaaataatctgttccttgtgaatattctctgtaatagtctaatagtattttgtgctcctgggggctgagtgtgtttttagcaacaatgcattggttgtaaaatatgcatccctaactatctggacagacaagaaagagggctctagtaaaaagactgaagtttttttttttaaatgcagatcgtatgaatcacataaatggtggtgtctaaaaattatcaacaagctctgggtttgtttttatttctttacattataggtcctctttctcactccacatttttgatattactagatcagtaattcaagagacagccaagcaggtgttcacatctct

SEQ ID NO: 89481 - DNA, 217 bp, Homo sapiens
tatcagcaaaaacagaaattgaaaatctaaaaaaaaaataacctgtcatttacagtaacatcaaaagtatcaaatatccaggaataaatacaagaaaatgtacaaaagatctacatagaaaactatgaaacattattgagaaaaataatagaagacctaaataaattttctaatactgcgtctcatggactggaaacaataaagatgtcatatgtag

SEQ ID NO: 89482 - DNA, 574 bp, Homo sapiens
agttaatgggtgcagcaaaccaacatggcatacatatacataagtaacaaacctgcacgttgtgcacatgtaccctagaacttaaaaaagtacaattaaaaaaaaaatctattaccatacttgtatgtctatttctagactctctctcttccatggctctatgtacctactctttcacctatactacactgtattaattaccttagatttatattgtgtcttaaaactaggtaatgtgagtcctccaactttgtttctttttcaaaacagttttagctattctggtttaacctttccatataaattttagaatctggttgtctatatctacaatgaatctagctgagattttgactgggatcacattaaatttataggtcaatttgactgtatcgagtgttgtaatccatcaacacagtatacttcctcgtttattttggttgtcttggatttccttcagcagcattttgtaactttcaacatacagattctgcacatgttttgtttgatttatacctaggtagtttttttttccccctccttttggagctactataaatggaacttaaaaaaa

SEQ ID NO: 89483 - DNA, 264 bp, Homo sapiens
ctgagtgtgtgctacataccatgcgccagtgctagacactttcatgcatcatatgtaatgcttacaataacttccaaagttgatgtttttattttccttttacggaaaagtaaacaacttggagcaatcagggaattaattggtcttacagccactactcaagtccagacctctcagactccaaagctcatcctctttctattgcatcatgctgtgtcttgaactgcatacagtgttccataaacaatctggaaggcaggcacg

SEQ ID NO: 89484 - DNA, 458 bp, Homo sapiens
gcctttcctccaattcaacatgagatttgggtggggacacaaatctaaaccatatgttttctgatttttgaaaaaattttataatttttttctatgagtctgtcacatttcttttcaggtttgctcataggtgttttataattttagttgatattgtgaataagatctccctccctacccccattacatttgctaagtggtttttgatatgttactggaaagctgctggttttggagtgtttattagcatctttattcagccatgtgcctggaccattataaaatcttttttgattgagccttttttgtattctaggtagactatcagaaagttcataaatagtgatagtttcatgtttttatttctatttcctttctgttttagtaatacatttaaggattgcccattaaaaatattggacaaacagttatttccaggcaacatctttacctcattc

SEQ ID NO: 89485 - DNA, 409 bp, Homo sapiens
atgctcacaacaacccctcatatgacttacattaaaaagtttacaattattaattaggattggaagtttccaacagatttgtagtcaggagagactattcagggaacatgagtctagttttgatcacattgagtttgaagttcctgaacaaacacgtgtcactaaaggagtgaagataaacatgcttctagagtaaaaacaatcacaagtacaaacctctacaacatcttacacagggaaattcagccctaaagtctatcaaatgggcataaaggtaattttatatttgtataatcttaggttatagccaagaaaaagcaaacatcttgtgaagttgagatatagcatacaacaaactcagctcaattaaaccacagtttagctttatctaattcaaagttaggacgcc

SEQ ID NO: 89486 - DNA, 708 bp, Homo sapiens
aaacagtgatagtttgacttcttttcttcctatttggatgccatttatttttttctcttgactgactgctcttgccagaccttccaattctatgttggataggagtggtgagagagggcatccttttcttgtgccacttttcaagggaaatgcttcaagcttttgcccattcagtgtgatgctggctgtggttttgtcatatatagctcttactattttgaagtttgttccttcaatacctaatttattgagagtttttaagatggaatgacattgaattttatcaaaaagccttgtctgcatctattgagataatcatgtgtgatattttcctatttggctaatcattttatcattatacagtgtccctctttgcctttttttactgttgttgctttaaaatctgttttttctaatataagaatagctactcctactcacttttggtttccatttgcatggaatgtcttttcccacctctttcccttaagtttatgtgagtccttatgtattaggtgagtctcttaaagacagcagatacgtggttggcggattttcattcattctgctattctgtatcttttaagtggagcattcaggccatttacattcaatgttagtattgagatgtgaggtactgttctattcatcatgttagctgttgcctaaaaactttgttttttccattgtgctattgttttacagacc

SEQ ID NO: 89487 - DNA, 230 bp, Homo sapiens
tctgttaaaaaaaagtaaaaatgttacacataggaaataaatgtaaaaagctatactttgccaaaataaagtttcagctgaaggtaatgctagttataaattaaatacaattctattaagaacttgcaaaagtcaaaggaagacggaaaactccctcttttggcaattcaaaggcaaagacctgttcatttattcttaattttactttatacaatcattatcccccacag

SEQ ID NO: 89488 - DNA, 474 bp, Homo sapiens
agtctttaaaagcagtgagggaacaggggaacactgcctgaatcctgcccacaacctttggccagtggggatctggcagagagacctgttaacttttgaagaaattaacatctgcaaggataatcacataatgagcctttgaaagagtatgattcaaatatctaatgattaagagaagcctttggggagtggtgctctcgaataattttacaaaagttaattgtatgatttgtgttgtagaagtcaaatatgaaaaaattttgtagaaaaaattcttcccctcctcctcccaaaaaacccatcaatggactcattctttgtttatttcaagaatggtcacatattatattctaatcacatattgtaatctaatttttattaaagatagtcatatttccaaaataaagtttttccccagttttccttcttgtggtaaagtacatataacacaaaatttaccatcctaaccatttt

SEQ ID NO: 89489 - DNA, 276 bp, Homo sapiens
tgaggatatgggcttaaagatattgagctatgtgcccaagattgccacagctcatgagtgccaaagtcagaaatttcctaaattggatccttaatcaccagacatggtgcttaattaccatgctggacaggattctgttacttgaaaacctgtgtagctctcagaccactggctgtgcacagtaggcacttaaatatttaatttgaggtttatgattcttgctgattttcagagtattgcccttcagcctgggcaacagagtgagactccatctcc

SEQ ID NO: 89490 - DNA, 514 bp, Homo sapiens
gctgggagcaggtatccgtgactgtctggggctgggacatgttacagccccagacagcattgggaatgcaggggaggaggacacttggatatggaataggcagctagcagggtctgtctcaggcaggaaaccgaggctcagagaagtcaattcacttggccaaggtcagcctcgcctccctcaggagcccctgccctgaatgctccatgtgttacccccctgatgaccagtgatgtttcctgggtgcttcctgtgggctgagcctcaggcagggctcttgctgtggatcagacatcgcatagtcacagcgaccctgtgatgtgggagcactccccgtggtgtacactggccggtgctgagggctggaggatctcttggatacccggggtccgacccaccgttgatcacaggcctgtgggtaccacgctgtgcatctaggccgctctcccggccgtgaccctcagccgccctctgaggaggccgccgtggcattttatgcccaagaaactgggtc

SEQ ID NO: 89491 - DNA, 244 bp, Homo sapiens
agagcgagactccgtctcaaaaataaataaataaataaataaataaataaataaatctcttaaaggattgcctctgaaaccttttgcataatatgtaagtttcttcataatctcatctttgctcttctttctagttttgatatcttgctgctctcccacataaatgctgaagctcgtggaaattaaaatatggctattagaactccagagcatgtgctctgagtgacataggcttgtaaacatg

SEQ ID NO: 89492 - DNA, 433 bp, Homo sapiens
atatttcatcgtgtacacccaccactttctaccactccactccacagagatgggcacccagagtgcctccaactctctgacactgcaaataatgttgcagtgcacatcctcacacaagtctccttatatacttgtttgaaaatttggtggccaggcccggtggctcacgcctgtaatcccagcactttgggaggccaaggtaggtggatcacaaggtcaggaggatcgagaccatcctggctaacacagtgaaacaccgtctctactaaaattacaaaaaattagccgggcacagtggcagacgcctgtagtctcagctacttgagaggctgaggcaggagaatggtgtgaacctgggaggcggagcttgcagtgagccgagatcacgccactgcagtccagcccgggtgaaagagcgagactccatctcaaa

SEQ ID NO: 89493 - DNA, 670 bp, Homo sapiens
gtattcttcccaacacacaacccggctacctcaccttcctgcaacaaactctcagtggctccctcttaccacgaaaacgacctccggctcctctgcctcttctgtggtcttgtgcctgcccctctccagcctcctccctcccacaccaccttcccctcttagtctctaacgccatctgtttgtggctctctaaggctcaagggcgcccactgccagtgtgtatggagaagtcctgccaggctccctgtcacctaccttcacatggccacttaggggagctcctgctcgctgccacctatgtgggttgtctagatgcccaccgtgcgatgacagagccagtcaggaggaaatatcttaatccttgcattccccatccctagcactgtgctgggtacctggcaggcacttgataccgttggcagaaccagtaaatagtggtggctagagccaaccgtggcactggggacagaaaagtgaggccagatgagggcaccgctgacttcacccaccatagcccatttctatatttgctgaaaataaggattattttttgaaataaataattttgctagcccatgcatatttcccaacatgttcttgcatttgcattaggccaatatacattttttaattgagagaagtgagagaggagtgaaggggggaagtagct

SEQ ID NO: 89494 - DNA, 473 bp, Homo sapiens
tacagccactgtggaaaacggtatgatttctaaagcaaactgaaatagaattaccattcggtcctgctgtaggggtttagtcaggatggtggggaaaattataagccacaaaccttcttggaaggcctgaagggttttgcaaaagtctcaggataaggttatgtctgaaggcaacctaatccataccttgagtaaatagcttaaagtgggtacaaaggaaggtagagtagtttacctgactagtttgtttactcatgtggtcctaagactaacctttgatctaccacaggtgcttaattgctttctactcaggaagtccgggaagtctgcaatgtcaattaccctctagttgtgtttactcacaacctttgtcaattaatctttactgaataaatgcaagtcttgctgactgatcaaggccgtggctgtgactaagtggcctggacgctaggctggactggcaaagcagaaca

SEQ ID NO: 89495 - DNA, 167 bp, Homo sapiens
ttaaggcatttttaaaaatctggctttatacacatacgaagctgaaaatggaggagtattttaatagctttttcagaaaactgtggctattcttgtttgattctacacgaaactgcagtaagtaaacttttcttaatctgtcacattaaaatccatcagtcagctgg

SEQ ID NO: 89496 - DNA, 460 bp, Homo sapiens
aggtgggatggggccactcacacttggtgtggaggctgcagaggaaggggaggccatatggcctaggttttgaacttgggagtcaggctggttggttaccggggcctggcatagctgatatctgacaggacggcgtcaagttacattggcagagcctgtggggtctcaggttgaatcatcccaccagcaggcacttgtctgtgagtccagagttcagtggatagggcaggatcgagggccagtaaattcagctgataagcccccactctggtatgtcagccctcgaagacactggatcctgcatcccacagtcagcccacagttcccagtgagatcagagcagctaatgctgcggatgctgttctgagacttcccgggcagccgcggctgctcatcgtgtcgtgccacccctgtgagggcagttgcacccctgcagtggcacctgcagttctgacagggc

SEQ ID NO: 89497 - DNA, 327 bp, Homo sapiens
cctgacctacctgttggctccagagtctgtctaccccactgctcccccaactcctccctctccttatcccatacccagcatgaaatgataagacctctgcatttgcatgaagattgatctggtcatcttaaagaggcgcttctgggatactaacagaagtctgagcagagcagagagaggtagcaggaaagaagatttttatctcttatcagttcacatggaataagcacccagatcccagagaggctgagaaaagtaatctttcagctcatctggagacacccatattgctgcccacgccaccaccacccccagcatttagcccac

SEQ ID NO: 89498 - DNA, 318 bp, Homo sapiens
ggtgacgaggaagcccaaggctactgttccttctgtgaacaagaggcccaagaaagagaccaagaagaagcggtagaagaggaggcccgaggagccagacaggcagggagagggccttggggacagccctcctgggaatctatatcctgttccccctctccatcccaggttcagggtctgaggaggctgtgacaccctctgacctcagagatctagacagtcatgacagtccccaggctccagctgtgcagtccaccacttcctcttccttctgcttctgtgatggtttagagtcaaggggactgaaacacactgtga

SEQ ID NO: 89499 - DNA, 591 bp, Homo sapiens
tggaaagcaaatatatgagtggtaacaaagttaccaaagaaaaacgcatcctcaactagcagtgaagctgagtgaaataggagaactgatctaatttataatgcaaaatacctgtacaagtggggctaacagaatatagctaaagcaaggggaatttcttgaaaacctgcttatgaagttatcagatccccaggtccattcatcctctctagttagctggacaactgcccttccttcatcctgcaaaagtcagatagaactgctcaaaaaaaaagaaattcaaaactggaactgggtctataaagcttgatgtcacattcaggtttaaaaaatgaccaggcgcggtggctcaagcctgtaatcgcagcactttcggaggtcaaggcgggcagagcacaaggtcaagagttcaagaccagcctggccaacatagtgaaaccccatccctactaaacatacaaaaattagcccagcatggtgcgcctgtagtcccagctactcgggagcctgaggcaggagaatcacttgaacccaggagaggttgcagtgagctgaaatcatgccactgcactccagattgggtgacagagc

SEQ ID NO: 89500 - DNA, 334 bp, Homo sapiens
aatatctaacttaggaatgtggaaatttgagctgagaagaacaattctacatttgactattattaatattttctcacaaaatatattgaaggaaaaatgatgatgaaatgttatcttcagctttagtagaatatagagactaaactataaactaatttggtttctttattttgctacatattgctaaatattgcctctaaaatagatgtgttgttttagctttagacagtttaaaaaatgttattttttcccaatgaaataaaaacaaatgtaaccacacccatatatatttcatagtcctagaatagtattagtagttgtctttacttgtaaa

SEQ ID NO: 89501 - DNA, 314 bp, Homo sapiens
atgtaatatagccacacaatggaagattatttggccataaaaacaaatgaagaactgaaacatgctacaacatgaatgaacctcaaaaacattgtgctaaatgaaaagccagttccaaagggctttactatacaatgcctttaggaaacatcccaaatagacaaatctagacacagaaagtaaattaggggtagcctagggctgagtgttgggaggaaatggggagtgaataccaatgggtacggggtttctttgggcaagataaaaatgttctaaatttgattgtggtggtgatgcacacactgtgaatatac

SEQ ID NO: 89502 - DNA, 738 bp, Homo sapiens
cggaaactcccgcacagtggcggaggcccggcttctctgcttctccagatcccggctctgcgcctggggtttgcatcgcccaaccttggccgctgcagcagcagcactgctggctcaagaggccataaggatgaagcaagagaatcgctcgaacccaggagacggaggttgcagtgagccaagatcgtgccactgcattccagcctgggcgacagagtgagactccatctcaaaaaaaaaaaacaaaaaacaaacaaacaaaaaaccataaggagcccactggggttgggtgggaaggtgcaggctgcggtcagagccacgtttctgcaaggtggcccgcggtggtggccagacgctatcccagggccaggggctagtggggcaggggctcagaaatgagctgctcatgcccacactggatcacgatcacatcccacccacctcaggtcggcactgcctgttccttgaagttcagggtctacctccccacccagcgtggtgctgcctcagtttacctgtttttccatgcgaccgcccacctcgctgacattctcatcccttgtctttaccctaaccgcacctatctgtgtggctctctctcatttccaacattctggctccctgtctcaccctgccccagttttggtctccaactgatctggagttttcctgtctccccatctgagtctcttgctcttggcctcctcctccctgtctaattctatttcgatgtttttg

SEQ ID NO: 89503 - DNA, 255 bp, Homo sapiens
tcctttgcctattttctaattgggttatctttctaatgttgaaattgtaagagttctttatgtatcctggatactggatccttatcagatatacaattttctctcattctttctttttacatttttgataatgcccttagatgcacgaaagcgtattagcttttgtttatctgtgaatgtcttaacaactttttttttttgagacggagtcttgctctttcgcccaggctggagtgcagtggcacgatctcagct

SEQ ID NO: 89504 - DNA, 1646 bp, Homo sapiens
cagtataatattcttttctaagttttcctttcagatttactgttatgttggctttagtgtaagacaaggtcactgtgctgattgatttttatctaaaaaaattcatttttatatcgaagaaaaaatattttattcaaacattagatttgaaagagtaatagtttataaaataaggaagtaacatgtgaggctctcccctcctcccctcccccatcataaagatattttgaaatcccaaggtgccctcatacctcttgacattaatgacttcattttttagcttgaatttgttagcaaatattaatggcagaaaaccaaaaactaaatttatggtatcgagagcaccaccttctctttttgcccatattgcactttgatttcaaactatgcactgtgaagagatttttttccccaggtaggaagggatgttccctgttatcgttattttactgagctgtggaaactcatttttaccctttttaaagtcataaatatggacttaatagcccttaaccttcaagtccaagcagttccaatcaggctgacttaggatcatgctggaaggaagccaagtctcaagaactgtcagcaacagaaaatgagatatgatgctagagagcatttgtccttgactgtaagtacagaggcttaggggaagtgagacataagcttgtaggaataataaacgttctacaataaacgtttggctatcttaagccattgtatgggggggattaggaagtaggagggattgtcctacaacaggcccttatacttcaacagcccaaatatttggtttattcctttttatccataaagtctttattcttcaagtttgggtattatagattaccattgttagcctcccttaatgggaccatatgagccaggcttttaagacggactcattttgaattgagtttcaaactttgaaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttttattcccccttcaaaaattttttattggatatatatatttttcagtattcagactctgaaatctgtcattacaatcaagtgcttgtcacagctgaaagatttctggtggcttaaagtttactagcagtaaatttatgatatggtacagttctttgtacagaaaggcaccattatgttagaataaatttccagaacttagtgggaagaatcaggttttaaccttgtgtgtctgttacttctgagtgcatttctataatataaatgttgatttgcgtcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttttaatgta

SEQ ID NO: 89505 - DNA, 2133 bp, Homo sapiens
  misc_feature (1808)..(1808): n is a, c, g, or t
  misc_feature (1816)..(1816): n is a, c, g, or t
  misc_feature (1829)..(1829): n is a, c, g, or t
  misc_feature (1953)..(1953): n is a, c, g, or t
  misc_feature (1992)..(1992): n is a, c, g, or t
  misc_feature (2004)..(2004): n is a, c, g, or t
  misc_feature (2031)..(2031): n is a, c, g, or t
  misc_feature (2044)..(2044): n is a, c, g, or t
  misc_feature (2073)..(2073): n is a, c, g, or t
  misc_feature (2093)..(2093): n is a, c, g, or t
  misc_feature (2102)..(2102): n is a, c, g, or t
cagtataatattcttttctaagttttcctttcagatttactgttatgttggctttagtgtaagacaaggtcactgtgctgattgatttttatctaaaaaaattcatttttatatcgaagaaaaaatattttattcaaacattagatttgaaagagtaatagtttataaaataaggaagtaacatgtgaggctctcccctcctcccctcccccatcataaagatattttgaaatcccaaggtgccctcatacctcttgacattaatgacttcattttttagcttgaatttgttagcaaatattaatggcagaaaaccaaaaactaaatttatggtatcgagagcaccaccttctctttttgcccatattgcactttgatttcaaactatgcactgtgaagagatttttttccccaggtaggaagggatgttccctgttatcgttattttactgagctgtggaaactcatttttaccctttttaaagtcataaatatggacttaatagcccttaaccttcaagtccaagcagttccaatcaggctgacttaggatcatgctggaaggaagccaagtctcaagaactgtcagcaacagaaaatgagatatgatgctagagagcatttgtccttgactgtaagtacagaggcttaggggaagtgagacataagcttgtaggaataataaacgttctacaataaacgtttggctatcttaagccattgtatgggggggattaggaagtaggagggattgtcctacaacaggcccttatacttcaacagcccaaatatttggtttattcctttttatccataaagtctttattcttcaagtttgggtattatagattaccattgttagcctcccttaatgggaccatatgagccaggcttttaagacggactcattttgaattgagtttcaaactttgaaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttttattcccccttcaaaaattttttattggatatatatatttttcagtattcagactctgaaatctgtcattacaatcaagtgcttgtcacagctgaaagatttctggtggcttaaagtttactagcagtaaatttatgatatggtacagttctttgtacagaaaggcaccattatgttagaataaatttccagaacttagtgggaagaatcaggttttaaccttgtgtgtctgttacttctgagtgcatttctataatataaatgttgatttgcgtcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttttaatgtattctctactgttttgatttttggattttcttaattcaacatttgaagatgtgccttttgggtaatgttaatcacgaatgtagtaatatttcatgattgtaataatgttacatgatcatgggtgtggcattctctaacaaatgatgtgaaaggaaaggaaggntttcccanaaaaccccatggngcctggattgccaccaggccccaccttgcctttttgggaaaatgccaatggccaaagccaaaggggggcctcccttttaaaggggaaccttccaggacctttgggaatttccgggaaaacccanaaaatcccaggtgggggcccaggtgggggcccagggggnccaccatggcanaggggggcctaacaaggggccccgggnaaagggccaaagnccgggaaccaaaaaggaagccggccgggnaatggggggccaaccccggnaacccagcnccttggggcccaaggggggggcacctaaacc

SEQ ID NO: 89506 - DNA, 2788 bp, Homo sapiens
cagtataatattcttttctaagttttcctttcagatttactgttatgttggctttagtgtaagacaaggtcactgtgctgattgatttttatctaaaaaaattcatttttatatcgaagaaaaaatattttattcaaacattagatttgaaagagtaatagtttataaaataaggaagtaacatgtgaggctctcccctcctcccctcccccatcataaagatattttgaaatcccaaggtgccctcatacctcttgacattaatgacttcattttttagcttgaatttgttagcaaatattaatggcagaaaaccaaaaactaaatttatggtatcgagagcaccaccttctctttttgcccatattgcactttgatttcaaactatgcactgtgaagagatttttttccccaggtaggaagggatgttccctgttatcgttattttactgagctgtggaaactcatttttaccctttttaaagtcataaatatggacttaatagcccttaaccttcaagtccaagcagttccaatcaggctgacttaggatcatgctggaaggaagccaagtctcaagaactgtcagcaacagaaaatgagatatgatgctagagagcatttgtccttgactgtaagtacagaggcttaggggaagtgagacataagcttgtaggaataataaacgttctacaataaacgtttggctatcttaagccattgtatgggggggattaggaagtaggagggattgtcctacaacaggcccttatacttcaacagcccaaatatttggtttattcctttttatccataaagtctttattcttcaagtttgggtattatagattaccattgttagcctcccttaatgggaccatatgagccaggcttttaagacggactcattttgaattgagtttcaaactttgaaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttttattcccccttcaaaaattttttattggatatatatatttttcagtattcagactctgaaatctgtcattacaatcaagtgcttgtcacagctgaaagatttctggtggcttaaagtttactagcagtaaatttatgatatggtacagttctttgtacagaaaggcaccattatgttagaataaatttccagaacttagtgggaagaatcaggttttaaccttgtgtgtctgttacttctgagtgcatttctataatataaatgttgatttgcgtcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttttaatgtattctctactgttttgatttttggattttcttaattcaacatttgaagatgtgccttttgggtaatgttaatcacgaatgtagtaatatttcatgattgtaataatgttacatgatcatgggtgtggcattctctaacaaatgatgtgaaaggaaagtagttttcataaaactcatggctctgattgcacagtcccacttgcttttgatattgctatgtcaaagcaaagggcacttcttttaaggctactttcagaactttgtattttcgctaaactataaatgcagttgtgtccagttggaggccagggtaccacatgtcacaggcggccttacatgtgtgccgtgaaaaggttcaaagaccgttaacaaaaaagtaagtctggccgggcatggtggctcaagcctgtaatcccagcactttgggaggccgaggcgggcggatcacttgagaccaggagttcgagaccagcctggccaacatggtgtgagaccccgtctctactaaaaataaaaaaattagccgggtgcggtggcacacacctgtaatcccagctaccggggaggctgaggcaggagaatcgctagaacctgggaggcggaggttgcagtcagccaagatagcaccactgcactccaggctgggtgacagagcgagactccatgtcaaaaaaaaaagaatgtgggaactcaaattttcatttttaatgtaatccccaagattttctccaagaaataaattgttgttttgtattttgtaacttaaaagcagctattggtaaatttctgagatatagcaggagaccaaaacatgtttggaaagagaataaatatatgaagagagactggttgttttattttcaatgtattgaatatattagactactatttattttctgagtggatgtgattaaatattcagacgtttagtgtatgattaagagtgagatagagatttctttggagtaattaaatccatcctgtcttttacacaatggacaaatcaagttaaaaaaatttttagatagcttagcttgttttctggtgctgttgacctgcaagagaatatacttttgcatatacaggtgaaagttttgcaatttatgtatacaagaaattgtaggcattaaaaatattttattga

SEQ ID NO: 89507 - DNA, 3175 bp, Homo sapiens
cagtataatattcttttctaagttttcctttcagatttactgttatgttggctttagtgtaagacaaggtcactgtgctgattgatttttatctaaaaaaattcatttttatatcgaagaaaaaatattttattcaaacattagatttgaaagagtaatagtttataaaataaggaagtaacatgtgaggctctcccctcctcccctcccccatcataaagatattttgaaatcccaaggtgccctcatacctcttgacattaatgacttcattttttagcttgaatttgttagcaaatattaatggcagaaaaccaaaaactaaatttatggtatcgagagcaccaccttctctttttgcccatattgcactttgatttcaaactatgcactgtgaagagatttttttccccaggtaggaagggatgttccctgttatcgttattttactgagctgtggaaactcatttttaccctttttaaagtcataaatatggacttaatagcccttaaccttcaagtccaagcagttccaatcaggctgacttaggatcatgctggaaggaagccaagtctcaagaactgtcagcaacagaaaatgagatatgatgctagagagcatttgtccttgactgtaagtacagaggcttaggggaagtgagacataagcttgtaggaataataaacgttctacaataaacgtttggctatcttaagccattgtatgggggggattaggaagtaggagggattgtcctacaacaggcccttatacttcaacagcccaaatatttggtttattcctttttatccataaagtctttattcttcaagtttgggtattatagattaccattgttagcctcccttaatgggaccatatgagccaggcttttaagacggactcattttgaattgagtttcaaactttgaaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttttattcccccttcaaaaattttttattggatatatatatttttcagtattcagactctgaaatctgtcattacaatcaagtgcttgtcacagctgaaagatttctggtggcttaaagtttactagcagtaaatttatgatatggtacagttctttgtacagaaaggcaccattatgttagaataaatttccagaacttagtgggaagaatcaggttttaaccttgtgtgtctgttacttctgagtgcatttctataatataaatgttgatttgcgtcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttttaatgtattctctactgttttgatttttggattttcttaattcaacatttgaagatgtgccttttgggtaatgttaatcacgaatgtagtaatatttcatgattgtaataatgttacatgatcatgggtgtggcattctctaacaaatgatgtgaaaggaaagtagttttcataaaactcatggctctgattgcacagtcccacttgcttttgatattgctatgtcaaagcaaagggcacttcttttaaggctactttcagaactttgtattttcgctaaactataaatgcagttgtgtccagttggaggccagggtaccacatgtcacaggcggccttacatgtgtgccgtgaaaaggttcaaagaccgttaacaaaaaagtaagtctggccgggcatggtggctcaagcctgtaatcccagcactttgggaggccgaggcgggcggatcacttgagaccaggagttcgagaccagcctggccaacatggtgtgagaccccgtctctactaaaaataaaaaaattagccgggtgcggtggcacacacctgtaatcccagctaccggggaggctgaggcaggagaatcgctagaacctgggaggcggaggttgcagtcagccaagatagcaccactgcactccaggctgggtgacagagcgagactccatgtcaaaaaaaaaagaatgtgggaactcaaattttcatttttaatgtaatccccaagattttctccaagaaataaattgttgttttgtattttgtaacttaaaagcagctattggtaaatttctgagatatagcaggagaccaaaacatgtttggaaagagaataaatatatgaagagagactggttgttttattttcaatgtattgaatatattagactactatttattttctgagtggatgtgattaaatattcagacgtttagtgtatgattaagagtgagatagagatttctttggagtaattaaatccatcctgtcttttacacaatggacaaatcaagttaaaaaaatttttagatagcttagcttgttttctggtgctgttgacctgcaagagaatatacttttgcatatacaggtgaaagttttgcaatttatgtatacaagaaattgtaggcattaaaaatattttattgatatttttgctggtttgcatttattgattaaaactttgagatattctttatctcatcaccctgaacatttttccagctagaaacctcggtatactcatcacacttcagagatatggtttgcctattgcacacactcctctgcttattctcccttacacattcatgtctgctctaacatgatagagcttctctccccctaccagcttagagaactgttctgctctctgacccatgttgggagaactgttaggtggtcagagcaatggaatcttttagtggctcaagttttggaagtttactcaaatggagggaggacacagctgggtatatggttcctcttgtcaaaatgagcagggtcctatctcttatgataaaagcagcttgagat

SEQ ID NO: 89508 - DNA, 482 bp, Homo sapiens
aaaataaaataatctctgattgggaggctctccctgcctctctgcctccataatcctaaaccagctgcggtgttcccagatcacaaacatttaggcttgtgtccactgtaaaggttgcttcagaattttctacctggatgtctgtatatccagatatgaaatgactggacactgtaggtggtgataaattcttccaccctgattactcatgaagcagaaataattagtgcctacctaacctgtgaataactatttgaattctgctattttcaagggtaagtggaagaactagtaacccagtttataactaccagttggcccgatcacctttgcctcaaagacctgccccttgggatgctgtgataggtttagtttttgccaagtaccagtgctatttgatagtctcaccttgcctgctcttttgtataagtgtagcccatgctgtgcattgcacgcagtgggtacttaataaatactgaatg

SEQ ID NO: 89509 - DNA, 432 bp, Homo sapiens
gcgagttccagaattaatggggtgttgctgagtccacttctggcagagccactatagcatcattctcacagggtggaagagaatctggccgtcttcacagtgtatttagtgggcacgcagattaccctctcaccaaatgtgaggggctgcgctgtgccacccaacattcctgtgttcaagtcctgatccccagtacctcaaatgactatttggagagagggacttcactgagctaatcaagtgaaaatgaaatcactggagtagatcctaatccaatatgacatgttcttatgagaacaggagatcaggacataggcacatatagaggaaagacggtgtgaagacacagggagaggacggctgtctccaggccaaggagagaggcctggaatagcttcttccctcacagtcttcggatgaaccctgctgaca

SEQ ID NO: 89510 - DNA, 413 bp, Homo sapiens
ggtaattttaaatttttgcatagaaggtggtttggagaaaagaaatacatttgggtttaaatcctttctctgccactggctttgtcgtcttataatttctctaggccttttcttctttgtattaataatatgagttgcttagaacttagagtttcagggtcactgtaaacgttagaaataatatacctcactgtaatcccagcactttgggaggctgaggcgggtggatcacgaggtcaggagatcaagactatccaggctaacgtggtaaaaccctgtctataatttttgtatttttaatagagacagagttttgccatgttgcccaggctggtctcaaactcctgggctcaagtagtctactcactttggcctcacaaagtgctgggattacaagcatgagtcattacacc

SEQ ID NO: 89511 - DNA, 493 bp, Homo sapiens
aagacatcgaaagactgaaatatctgcactacatctatcacaggatgatcctcttataaactgacttaatgccatattgcctttatattttaaaaagactagtcatgaatgacgtagcagagatatgactttccaacccagtacaagaaatttaaatagataggaacatcttcaggtataagtggccagaatggtagggaactgaaacatgtgatatgagcaatggttaagggaaccgggattaacaggaaattcaggaggaaggaatgtaataactatcttcaagtatatgaatgacagtcatctaaaagataaattatgttgctttctgttactccaacaaatagaccatcagccagtgatgaaacctacaagaataaaatactcaagtcaatatgaaacactaactttgtagcagccttctgtgttcaaaggtaaaaaataggagggtaaaaaataatatggaagatagacctagattaaatctcagtta

SEQ ID NO: 89512 - DNA, 760 bp, Homo sapiens
tcgtattctatgaaagactgataaatgcattaaacaacaccgtaattgattgaaaaatgcttttatatgccccattctcaaagatatttatgttttagccaaatatttaacctcatgctatataaagaagtcactgtaaaatttatccacagaggagggaaaagagaggaatagtggaaaaagttttcccagccttcttaatgccttacagccgctagctgtatttacttcatgtttccttttttacatgaaaataatatgcattatttctttccttgttgatttgtaaaatatatttttattctctgcggctgtctttattttttaaaataattatttatgaaactgtcttattataaactctgagaggaaacatgttgttttattcaacgttgtttttaccttatacccaacttaccccttggccaattttaggtccttaattagtactgattaataactgttaattataataaaatcatactactctataacacatgtaatagtttttgccaatgttaaactaagagactataattgcattgttttgatcctaaatataaaaattatgtagattctgcacatttttcataaaacaacagtgataacatcaatttatttatttatttatttttgagatggagtttcgctcttgtcacccaggctcgagtgcaatggcaagatctcggctcaccgcaacctccacctcccaggttcaagcaattctcctgtctcagcctccctagaagctgggattaca

SEQ ID NO: 89513 - DNA, 447 bp, Homo sapiens
aaataatttatatcatcaatgtttaaggagaaaaacagttgtcccaagcctaggcatcttgatcaggttcttagctgccctcttggttcagaagccataccgtgaatgaaattcagtggaagagctgcagcccagtgtccaatcccaccacaagagttgatcaaagactccctggccaccaccctgcacaggatctaacattaaaataaaaagtaggaaggacactacaattcagacaagagagaaaatgtttctaagtatctgggttttaagcacaattccaatcctttgaagttagagttacgtttagccttttacccttggccaacttttttggtccaacaactgaaatgataataaaagaagatagtttaaaaagtttaacagacaaaaagtccaaataggtttcttggacttgaatctcgtcttgcaaaacagcatttggat

SEQ ID NO: 89514 - DNA, 696 bp, Homo sapiens
aagtaaatccaatttctgtgaaatcaggatacaataatagaacctagcagcctgccggacacttggaaggtgctccatgaatgtcagccatttatacgtaaggtacatccaaggtctcatcttgtatctctgagaggcccagaaatcctttctcaggccatgcgtgcaacctattttggggttcagaaaagagagttgtcttatttgtggcttttttgctttagtgccccaggtcactctgtgtctcttggcctttctcatcatcttcctctacttcactgatctcatttccatggtgcctcccacgaattcctttgcccactcttctttgccagcctcatagccagaggcactttatgcatcaagcactgctggttcctcttgctgttgttttcatgaagttgccctacacaaaaacatatgaattttgcagatgaatggtttcatcctgggcaatgctgataggttttcagtttccatctgccgccccatctgtagcttccaaaaccactacttctcccatcccagaaagaatgagcaaacttaggagtcttctcaaaggggcggtagtgcccaagtcaggcacttctaagaggcactgaaaacttgggggatacttaagggtccagccagcccgacgtagccactgtgagctgctctgtgatttgacgtcacctccctgtgtcccctgcacaa

SEQ ID NO: 89515 - DNA, 415 bp, Homo sapiens
tgtgaaatgttcccaacacaaaaagatataataaatgcacagtaagggatagcctaagtactctgacttaatcatcccacaatctgtacatgtatcaaaatatcattggcactccataaatatacccagatattaggtatcaaagaaattttttaacaaatgtcaactttagaaggtaatacatgatctgcaacaatatctgcatttaaaagtttattcatccatcttatagtttcatgtttgggttaaaattttagtaaaaccacctcccaaatgcagagaggtaatgacaaagcagagtattagggatgtgcaattccaagagcacctttcttattgtatcctggagcttttattttttttttggcggagtctcgctctgtcacccaggctgagtgcagtggggctatcttgg

SEQ ID NO: 89516 - DNA, 441 bp, Homo sapiens
tctacgagctatctaaatgcgaggttgccctcagtggtaggaccattctcagttgtgttggaacaactggatagccatatgcagaagactatctcacaccatggaggactttaagtaaagtaagtcaggaacagaaagacaaatactgtataacatcacttagtatgtagatgtaaaaaatagttgagctcataaaagtagagagtggaagaggggtttccaggagctggggtgtagggagagttgaggccgatattggtaaaaggacaccaacttcagaatgaaaagatgactatcttcaagagatctattgcagaatgtggcaattatagttaacaatgtattgtattcttgaaaattgggataagagcagttttcttttttttttgagatggagtctcgcactgttgcccaggctggagtgcagtggtgcagtcttgg

SEQ ID NO: 89517 - DNA, 487 bp, Homo sapiens
cagcctttaaagttctccaacatcatcccagagacagatcagcctcagctcaaatggtaaacgcaaacatttggttaactcttgtacctggtcacaagaatcatttgtagaattttgtttagtaaaggtatcaaagcaaatatatattacttataactgtaagtgtggaactaggtggacatacccctttggtaaaacgttagatacccattaactatcagatgatttcccaaagtaaattatttctctgttgtaaatcttggaaagccaccacctctacatatctggtgttataaaatcaagcccatgtcataagacacagcattcaattgtgctggaacagcagctgaaactaagcaatatctcttgcccacttaaaaagtatggtttttccatactactttttcattatgggttccaagtcatacatggaatttcatcaggcataatcaattctagattaaccactcattcaacatttattgtg

SEQ ID NO: 89518 - DNA, 428 bp, Homo sapiens
tagacaattatcaatgttcctccctctcaaatgatccttctcaacacaggttgtgcttgatgaatctttaagaacagaatcttagcaggattttgtcaaatgccttttcttcatctgttgagataatcatgtttttctcttttagtgtattagcatgatgaattccattgattgattttctaatgttaaaccaatcctacatttttcagatgaaccccacttggttatgacgtactatccttttatccctttaatatattgtatttgatactctaaaattttgtttagaatttttacatctatgttcataagggatactggtttgtagtttcctttgctgtaatatctttgtattttctgctctatttttggaaatgtttgagtaaaattgttatttattcattaaatgtttgggagaatttaccctg

SEQ ID NO: 89519 - DNA, 796 bp, Homo sapiens
ctcatgtttcccactggagcatgcacatattgttacttggaataccacttgcatttctttcattcttgtaagatttttcttcagcttcagtaacaaactttaactttaaataggagccaggaaggaatattgagaatttttaaaaaatgtgtaaatgtacttagaaaggatattttgccatgaaggtttggttggtaaaggatataatagatgccttttaagcgtaggaatgaaagtgtggagggccagagatagtggaaggtgtgtcgtgtttagagatctgagtttgaatcctcattttgccacttaatagtggcatgactttggcaaagtaaactttaagagtctatctttccttatttataaaatgagaagatccatttttactctatagtgctgatagtaagtgaatttagtgacagatagaaaacattcaatgaatgattgctgtttcaaaattgtcatatttactaaaaaaaagtaattcttaggataaaaaagtaaattttcttatcaaatgttcttttaatgtcaggtaggcatttcagtttcatgatgttcattgtagatattactggtagctgtatttccttggttcctgtatgtcagcgtggtagacaaagacaaaaatgagaaaaccttgaatgtgggagcacacgaatttatatagatgaaattgtacagtaccatgtacttcattaatatgcacttaatgaaagtttattaaaattgaatgagagttgaaggtattcaatatcattttatttcttgcagtatttaggttactgcagacaac

SEQ ID NO: 89520 - DNA, 323 bp, Homo sapiens
ggaaactaccagcaaactacagccagccaagagaaaatgagcaaactttagctacaggactgagagtaagaatcaaatgtttttaactccagatctaaaacaaacaaaaataaggctaggaataggaaaaataaaggtgcgaatgaggatgacagaatgttacatactatgacaatgtaggaaaacttgaactgccaaaaatacatgagagaaaggagagataatttggaagtagcataagtcttgaaagcttcctctgtaattgctcagaatctaaaggtatctttaagggtggcaagtcaagtagaaggataaatgtataa

SEQ ID NO: 89521 - DNA, 994 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccgggggtttttatttcatgaaggaaaagaagatccagtgaagtagatttcaattatcatgaaactccttttaaatcatctaagtttaaaacagacatcttacatttttaaattaggcactctcattattaaaatttgactgcaaaagggaaaatagtattactagcacaaaagaatgaggaatacacatgacctattttctgtctccacaatttaatcttaagtatatctcattagtagggctcactgatttgtacagaaaaataagatactaagagctggcttcattcacataataagctatttcttctcattttgataaatgtataattaatattagaggaatttctgaccaaaagttttgttgttttaaaaaggctttcttttttgacagctacaaacatagtggcccttgtccttccttctcaagtttatcagggtcttaacccaaatctctactttaaatgtgaagttaaaacttaaaattaattaaaatgtaagatttaagcatgaaaaatgacaaaattctggtccacagctgtaagtcagcagggtatattggtaacagactaccaaatatttaaaagaaattaatttatctgtattatcttcgaatttgctttctccaaagagggcatgtaaaatgaaagcactatagtcaagaaccaatttatacagatcgaagaactgtttttattgtactatgcaattacaattcaatttctctaaacttgatcaatccattgtttagaaatatcaaaatacttttatttcacacagtttgtatattatttataaaaaattccaaataatgctcttagcaaaatttataagcagtacctgttttaagctactaatgacaaagttagaaaataagagtaatattcacatattctaaccatttcttactaaaagtattatttcaactgaaatatttacacatgtataaaagcataatattttaaattttttgtatcag

SEQ ID NO: 89522 - DNA, 255 bp, Homo sapiens
ccggtccgacgtacagggcgactccctactaggaaaagaggaagcaaaggaaaatcctgaggatattagaaaacctgaaccctaggctgctctcactcaggtttagggtttgagtttttactatctggatgacacctaggttctccacaaaataatgtaaaaagcattctcaggttgataacaatactggtgccccctaatatgagtgactaaaagccttctctaggaagacctattttcaacctaggttgcaca

SEQ ID NO: 89523 - DNA, 104 bp, Homo sapiens
gatctgttttcttcccttcttgtatcatccctttgggtttttcggtttgctttggtttttcattttgctttgtttttgctataaatcctgtttttatcttataa

SEQ ID NO: 89524 - DNA, 150 bp, Homo sapiens
tacttgccacctccaaagcattagctctgaaggcataaccttttctttttttttcttctgaaagagacagggtctctttgcattgctcaagctggagtgcagtagctattcacaggcatgatcatcaagcaccacagccccaaactcctg

SEQ ID NO: 89525 - DNA, 494 bp, Homo sapiens
aaaaaaaaaaaaaaaagaaaaaagaaaaagaaagtagaagaacacagaaaaaaaagaataatataatgactgcccacattcctaccatcagaattagtcattgtgaaacaatatatatatgtataggtttcctgtttttcttgtttaagaaatgaaagggataaaagtaaattcccctttactgcgtgcttccagttttcactccctccccagtctccactttgagtttggtgtgaacattttcctaatgtgttttggtttttgttttttggagacagagtctcgctctgtcacccaggctagagtgcagtggcccgatctcgactcactgcaacttccacctcccgggttcaagcgattcccctgcctttgcctcctgagtagctggaattacaggtgcggtgcccgccaccacacccggctaattttttgtattttagtgacggggtttcaccatgtcgcccaggctggtctcgaactcctgagctcaggca

SEQ ID NO: 89526 - DNA, 1132 bp, Homo sapiens
cccgcagcgccctcgcccagccccggctgcgtttccctgcccatgacccgctcgtggggacccccggcccggcccggaacttttctccccaacccccaaacccacgactcacttccacaccgtcttccccagcgtcccccgacccacttcatcctttccggccatccctcggaccttgacccccctgtccgcgccttcaaggctcccaactcaggcaccaggtccgcacctctcccgcgccccagagccggaaatttctccctcccagaccccgcgctgctcttctaacttctagatcttttctctcgcttctcagctgaatctctctgaccattcctctactggagcccccaatgaaagccgcaaacctatacccttgacgcccatacctgcctcagtttccccatccacacctggacgcaggccctgccgccctgagaccacagtccaaccccagaccatccctctggcctctgctgaatctcccagagtgtgtccatctggggatctaatcttcacccttcttgaagtctccgatctgtccctgatcccatccatgctcaggccttaggtctggccattcacacacacacacacccccacaccccactcccacacacagttcctactgtcttcagtccatggggatctcatcacccactcccagccccagctccagctgccctcacctctctagcagctctcacccctctgagtctacctaacctggagggggcttgaggggcacttcagggccctgccccctaatgtaacccctctctcaccccggcacaacctgggcttccacagtctggagctgccctacccccagattctctgagcactttcccccatccccagggccacagatccccttccttacttgttggggggaggtctggagcacctcgccaatgcccttcccccatccggctgggtccttccagttatttatttgtgtattcatttatttatctatttattattctatttaatctcttggcctcacccagggaccgtctggcttccccagctggactgggaggtcaggaagccaggcaaggagagggacagcacaggccacagagggctgcccccaccacacacacccccgcgtctcgggagaaaccca

SEQ ID NO: 89527 - DNA, 318 bp, Homo sapiens
actgtgcccggcagcaccttttctttatggacatagattttggtatttcctttaccaaagggaagataggtgggactacttctggttatatgcttcgctttaggcttgaagaacagttgctgtaaagattttattttgtgaaagacccaaggttgaaatgagtcggattcattggaatccattacttttccagggaataggattttaaatgaaaagctaagcatcctctctttcaatatctgccctcacagtgtgcctgagttgcatttacacttagagtgacagatgagactcgggtgtgtgtgtggttggaaggct

SEQ ID NO: 89528 - DNA, 409 bp, Homo sapiens
ctcttactcttattcatctcagtgctgcaaattttagccgatacaagaaggcaaaaagaagaaaaaagacatacagattagaaaataagaaataagactttccctatttgcagatggcataattgtctatgcaaaaaaaaaaaaaaacccatgaaatctcaaaaaaaaaccttcctagaattaataagtgagttcagtatggttgaagaatacacgataaacatacaaaaatcagttatatttctttatgttaacagtgaacacacggacactaaaataaaaatgcatatcatttgtaatcacttaaaaaagaataaaaagtttaaatctagcaaacattacagaatatgtatgcttagaatcataccatgctggtgaaagaaattaagatctaagtaagtgtaaaggc

SEQ ID NO: 89529 - DNA, 590 bp, Homo sapiens
cagaaaatttctccggatgacatcacaccggtcttctgaaattttcccattgcaaacaaaagcataaaaactaagcttataatcctcatttaaatttaaaactataaaaatttcctatataccaaacaccagggaaacatgttatgacagcttctatgtgagtggtcaagatcacgccctttgggaatttgggaagccaagagagagatgagtgaaatgcaaacaacaatctgcatggttcatgaccacaatgcctgtggctgaaatgttccaaaacacaccagcttaacacacagtcctgttatgtgtaagtggaaacaacactgaactcttgaaacagatccacgagtgggaatggtgacattccaatcaactgctctaatttcacccactgggaagccgcccgggtgagtaagcaagagtgtatcacgcctcttaagtttcttctcaaagcagcagagcagcggctgactcaaggtgtccctggaacctgcccacactcactggggacacaaaagggaacagggctggcacaagtgctttcagagacaccatgacccaacacccccaccagcaacattttagccatg

SEQ ID NO: 89530 - DNA, 277 bp, Homo sapiens
gagaggcgatgagatgagcccgggagaggggcagaaactgacatggtcagagatcatggtggccttgggggccactgggaggacttgggctttgactctgactctgaggacaggaggggccaccagagggtgttgagcagaggagggaggtgatcccacgtgggatttaacaggctccgtgttgagactagactgtagggcgggggtagagcccggagcctgtggcagcacttgcggtgagaggcaggggtggcttggccccgggaggcggtggaga

SEQ ID NO: 89531 - DNA, 162 bp, Homo sapiens
tgtccagtcctggtatctgcactctccgccttacgtttgctcctgctgaggagtgaaggtgactgtgacaggatgctttgttggcaccattgttgcttctgagtttgtccagttagttggatggccagtcactttgccctcatccttggtccatgttttctt

SEQ ID NO: 89532 - DNA, 486 bp, Homo sapiens
agaaggacctctctgttgtctcaggcagtggggtgttctgtggaatgcatgcctgatgccctgagtttccttcttagccttggagagagggacaaagctgctctcagatgtcataattactagcactgccccttatggaagtgggagatggaacctgtggtgaaatgcactgtggtctctgcaaggggagaggggactgcactagctccaagtcccgggcaagcaaaaacaatgtccacctccctatcatatccctgtcctgggattcctgactctctgttcagagagatattgtcgtttatttccatgctgcaccgtagttaatggctgtggaaaatgcttagccacagctatctgctgcaatggcctctgggcagaagttcttttgttagcccagaacagatagctctgcagctcacctattccctgttgcaggaactctgccgctccatgtagaaagggggaaggaccgtgccctctgttcaa

SEQ ID NO: 89533 - DNA, 2121 bp, Homo sapiens
ggcatctactgtgtgccaacatttgtgtgatactcctgggagtcaagatgtgatcctggccttgaagctattcttaaatgctttgactcttgagagctagtggtgttttagccacttactttttctgtacccattttttcttcactttgattttttcatttttctacctgtatgaactccaggtacttgttagcttttcgtttttaaaaatttgcatctttcctgatgtttctttagcttcatttgcaagaaacttgatgtttttctgatctaatcacttgctaagttaggccccactttccaattttctttctagctgattgtcgtcttctggagtcttccagctaatactgtgattccattcctgtctctaccatctctaacatacctggctgccatattcctttatattatatggaaataataatatgaggtatatctccattctggaattgagagtacatctttgatattctctcttcaaaaaacgtaaaatggtgatttttcctcattttatagtgagatatttagtcattataatttgttttctggtgtttattttttattgctaatgatgtgtttggcactaagatgttaaaagtgtatatgtatgatttttattgcaggcattataaactcctttggatttttatccaaaaatgaattcaggccgggtcagtggctcacgccggaatctcagcactttgggaggccgaggcaggcagatcacctgaggtcaggagtttgagaccagcctggccaacgtggtgaaaccctgtctctactacaaatacaaaagttagctggttgcggtggcgagtgcctgtaatcccaactactagggaggctgaggcaggaaaatcacttgaacccaggaggtggaggttgcagtgagctgagattgtgccattgcactccagcctgggagacggattgagaccctgtctcaaaaaaaaaaaaaaaaaaaagaattcagccaggcacagctgctcatctctgtaatgctggttgcttgggaggttgagatgggaaggtcctttgaagccaggagtttgagactagccttggcaacatagcaagaccctgtgtctactaaaaaaaaaaaaaaattttttttttgattagctgggtgtggtgggatgattgcttgagcccaggagtttgaggttaacagtgagctgtggttgtgccaccacactctaacctgggttgatagagtgagacccgtctgtttaaaaaaaaaaaaaaaaagaaaaaaattaatgtatataaattcaagaccattatcaaaaatcaaatgcaagtgagttggattatctaagctctaagcatgtaaaaaacttaagattacagcaggttacttactatatgcattgaactactgaattcaaatttcccagtttttcattttaagatttaatgattttctttactaataataacctatatgctatgatttgtaacttgcattttacaaagcaagttaaatgtggaacttgtgcgtttgtttaccttaggattaggctttactggcatcacagcatttttcagtaattactagatttcttagcatcttggatttcattgaaaaatgctcgttcagaagtaatgtatgaaaggacttgcagatacaatataaaaagtgagaaatcagggattgtgaaggtttttattcccaaaaaccttgctagttaaaataagacttgctgtaacatagcgtgtatagtttagagttagagattttatccattaggatttattaaaggaaataatgtctattgtaaatttaagataggttatgtgagagtataattaaaatatttttttgtgaaatgagttatttttatatagtctgtgatctgtctgaaaacatacaatcttgtttaaagtaaccaaaagcaaaaaccttaaggtacaatcgttagggtttgttttttggttttttttttctgggagacggattgagaccctgtctcaaaaaaaaaaaaaaaaaaagaattcagccaggcacagctgctcatctctgtaatgctggttgcttgggaggttgagatgggagggtcctttgaggccaggagtttgagactagccttggcaacgtggcaagaccctgtgtctact

SEQ ID NO: 89534 - DNA, 2332 bp, Homo sapiens
ggcatctactgtgtgccaacatttgtgtgatactcctgggagtcaagatgtgatcctggccttgaagctattcttaaatgctttgactcttgagagctagtggtgttttagccacttactttttctgtacccattttttcttcactttgattttttcatttttctacctgtatgaactccaggtacttgttagcttttcgtttttaaaaatttgcatctttcctgatgtttctttagcttcatttgcaagaaacttgatgtttttctgatctaatcacttgctaagttaggccccactttccaattttctttctagctgattgtcgtcttctggagtcttccagctaatactgtgattccattcctgtctctaccatctctaacatacctggctgccatattcctttatattatatggaaataataatatgaggtatatctccattctggaattgagagtacatctttgatattctctcttcaaaaaacgtaaaatggtgatttttcctcattttatagtgagatatttagtcattataatttgttttctggtgtttattttttattgctaatgatgtgtttggcactaagatgttaaaagtgtatatgtatgatttttattgcaggcattataaactcctttggatttttatccaaaaatgaattcaggccgggtcagtggctcacgccggaatctcagcactttgggaggccgaggcaggcagatcacctgaggtcaggagtttgagaccagcctggccaacgtggtgaaaccctgtctctactacaaatacaaaagttagctggttgcggtggcgagtgcctgtaatcccaactactagggaggctgaggcaggaaaatcacttgaacccaggaggtggaggttgcagtgagctgagattgtgccattgcactccagcctgggagacggattgagaccctgtctcaaaaaaaaaaaaaaaaaaaagaattcagccaggcacagctgctcatctctgtaatgctggttgcttgggaggttgagatgggaaggtcctttgaagccaggagtttgagactagccttggcaacatagcaagaccctgtgtctactaaaaaaaaaaaaaaattttttttttgattagctgggtgtggtgggatgattgcttgagcccaggagtttgaggttaacagtgagctgtggttgtgccaccacactctaacctgggttgatagagtgagacccgtctgtttaaaaaaaaaaaaaaaaagaaaaaaattaatgtatataaattcaagaccattatcaaaaatcaaatgcaagtgagttggattatctaagctctaagcatgtaaaaaacttaagattacagcaggttacttactatatgcattgaactactgaattcaaatttcccagtttttcattttaagatttaatgattttctttactaataataacctatatgctatgatttgtaacttgcattttacaaagcaagttaaatgtggaacttgtgcgtttgtttaccttaggattaggctttactggcatcacagcatttttcagtaattactagatttcttagcatcttggatttcattgaaaaatgctcgttcagaagtaatgtatgaaaggacttgcagatacaatataaaaagtgagaaatcagggattgtgaaggtttttattcccaaaaaccttgctagttaaaataagacttgctgtaacatagcgtgtatagtttagagttagagattttatccattaggatttattaaaggaaataatgtctattgtaaatttaagataggttatgtgagagtataattaaaatatttttttgtgaaatgagttatttttatatagtctgtgatctgtctgaaaacatacaatcttgtttaaagtaaccaaaagcaaaaaccttaaggtacaatcgttagggtttgttttttggttttttttttctgggagacagagttgcccaggctggagtgcagtggtgtgatcctggctcgctgtaacctctgccctcctgagttcaagcgatccttctgccttaatgtcccaagtagctgggattacaaacatacgccatcatgcccggctaatttttgtatttttagtagaaatagggtttcaccaagttggccaggctggtctcaatctcctgctctcaagtgatccacctgcctcggcctcccaaagtgctaggattacaggcgtgagtcaccgcgcctggcccatagtgaagtttttattttgtcatttagctatatctttggaaaaatttggaaatgtattttcatctccctaactttcaaataaaagttactattaacattttgaa

SEQ ID NO: 89535 - DNA, 286 bp, Homo sapiens
ggaaacccttttctcttggttctcattctctcttacctgccaccacataagatgtcctttttgccttccgctatcattgtgaggcctctccagtcacgtggaactgtgagtccattaaacctctttttctttataaattacccagtctcaggtatgtctttatcagcagcgtgaaaatggactaatacagcgttcaactggttggatgaggttcagccacattatggagggtaatttgccttactcaaagtctactgatttaaattttaatcacatctaaaaaata

SEQ ID NO: 89536 - DNA, 516 bp, Homo sapiens
tgttttccttgagaaaaggattttgacacattagtgatcagaaaatactgattactttttatccccagaactccacatctagaaatgtatgacaaagaaatacatcaaaataaaaatgcacgctctaagatgtgtataccagtgttattgcacaaaatttactacaacctacacccctaacaacagggtatggtttaagtaaattatggtatgtacatttgatggacgtcattaaaaacattaaccaaatttttcaaaggtgtggaaatatactttggatatcaagtaggtcgccaaactgtattaaacaaatgaggcaaaatataaacaaagaataatttcaaatccatgtgcaactgtatctgcagaggaaaaaaaagcctgaaaatagatgtattaaaagttattaaggctacctctaggaatttctatgtaaaggattattttcatttttaaagttttatgtattgtttcaaattttccatatttaatctgaaacatacagaaggagcctag

SEQ ID NO: 89537 - DNA, 634 bp, Homo sapiens
gacggtctttacaagcgactcgtgggcgtcaatactgggctgagtttgtggcgcgcttagtgatgggatggccctgtgcaggacgccgacacgaaaagatgaagagttcaatccgtgctgtctgaactcacagtgtagcaggcgagatagacgggaagatcggtagggtgggagatgccggaaaggcttcccgtgagactggataagaaatcaaaaatctggtgaaattgccggcaagagggagttaaggacattccaggcagaggcaaggctcccgctgaagtaacccagacgccagggatatctctgcccgctccactctgactctagtgctcaatgtgcctgccaggccttgctagggatgctgtgccagtgtgaagaggaaggtggtctccagctctcaccccatagaagctttctgcctcagtttccctaacctggaacaccacaatgactcctgaattgaaaaacactgcttacagcatctaggctaaaattggcagaatacctgggctccaagccagggagatttggagcgatggggaggtgcaagagcacagccagacagagccaaaagcaataatatcctgtttgttcctacactgccctccgcattaaaaaaacaacgacagct

SEQ ID NO: 89538 - DNA, 1254 bp, Homo sapiens
cctggccatcaggccccatttctgcccagcacagagactgctatgacccagtgatgacattgtgccctaagaacttccccacattctcttcaactcacagacgacctcagatgtagctgctctctcaggccttcaatgtacgtctccacccaaatgagtaatatttgcattacaaggaggaaaggagagagggaaccatcgggtacctgctgtaccaggcacattatatgctattgtccctgttttccagatgaagccagatactcctctatgaagttaaatgactggttcagtgttaacactgctagtgagcgacagagatggaatttgaacgcacacctgtctgactccacctcgtgttccttccacatggccagcaagctctgctgtcccacctcgcacttctgggaggtggctactccctctttccacccccttttctggatcttgacaagggattctaccctgccccagctgtcaaagcctgcagcagctgccaaaaaacctcaacacaggcatactttggacctacatcatgtgttgatgtcacagatgctgtaccaggcatttgactccttgatctaaagccaggattcctagccaacatggcgaaaccctgtctctactaaaaataacaaaaattagctgggcatggtgataggcacctgtaatcccagctacttgggaggctgaggcaggagaattacttgaacccaggaagcgaaggctgcagtgagcagagattgtgcctctgcactacagcctgggctatggagtaagactctgtctcaaaaaaaaaaaaaaaaaaaaaatagtgagggggatgcatgcccacacaaaggaatcctgatagaggaacaatggcttggtccgtttcccctcctgtgtagcactgtgataaaggaaagcctttcaggtatgtgcctcgatggagccagtgggtggaagaggaagggcaatgagaggtttgaggacaagctgctgataccctcatgtgtcatcacagtggtgccctttgggagcctgctttggtatactcgtccactcagggaagaggaagtctcttatccacagttttgtcttcaaaattgaaatttctttgggcagagcctaaaagagagttgcctcatttcgtgtaactgtagcatatgtagtgtagaggctccaatgtgtttttgaggcaatctgagagctctttctggaaatccctggcagatgacatctgcgtctgattttactttgtcttacaaccag

SEQ ID NO: 89539 - DNA, 928 bp, Homo sapiens
gacggtctttacaagcgactcgtgggcgtcaatactgggctgagtttgtggcgcgcttagtgatgggatggccctgtgcaggacgccgacacgaaaagatgaagagttcaatccgtgctgtctgaactcacagtgtagcaggcgagatagacgggaagatcggtagggtgggagatgccggaaaggcttcccgtgagactggataagaaatcaaaaatctggtgaaattgccggcaagagggagttaaggacattccaggcagaggcaagtccagattcctaagatgaggacacagcatcctgggccactgtcactaatacaaatttgcctctggagggactctacggaagataattcccctgaaatttggagagttgaattaagctaggactgattctggctggaatttgtggtggctacgtaccctagagggcctcaaggaaacccacggttcaagacagccctgacagattctggagtctagaacagaaatggatttgaacatgggcaaggccaaccacccagttcacggcctgtgtacagcaaagattacgttacagcctgagagctaagcctggaagctctttcatccatccgtttgtccatctatccatccatctgctcatccatccctccatctgctcaacaaacgttagagaatcaatccttgtgtcagatactggggctgccctcaaggagcttttatagagttcagggtacagccaggtgggggagacagatcactataaaaacctaccactataatccaaaggacaagagcaaaaatagtaaagaggagagaagacccaaatttgcctggtgggtcagagagggctttctagaagaggtaaaaaatcttcggggctatcacttcaccttgcctggtggataaagggaggactttccagatacagtggacagaatgtg

SEQ ID NO: 89540 - DNA, 494 bp, Homo sapiens
agtaaagctgggaagatgtttgtttgtaaggggtaatctgtgtctatcaaagcagatagtattggttttgcctagtttccaaacatggttttataagtcagtatatcttgtgaaaccattaggacaaaagtttggaacaaaaagaaatctcaggctcattgcaaagcttttttaacgttttcagttccctccatgttctgagcattatcataacgtactgaactgttctgttcagagaccactagggagaggagatgaggaaccagagcagccaggatgtttctccctgggataaaatctcaagcattcagacaccctcactgtgggctccacttctgtagctagaggggactggaaacagcaggagcatctcacagcttgtaggaagcacacatctttttcccaaatgtttctttttgcagttggtccttgctggctgatccagcttccccgtcagcatatggtgagcagttcggtgagaggaccacacttcc

SEQ ID NO: 89541 - DNA, 388 bp, Homo sapiens
tctgggaggtggctactccctctttccacccccttttctggatcttgacaagggattctaccctgccccagctgtcaaagcctgcagcagctgccaaaaaacctcaacacaggcatactttggacctacatcatgtgttgatgtcacagatgctgtaccaggcatttgactccttgatctaaagccaggattcctagccaacatggcgaaaccctgtctctactaaaaataacaaaaattagctgggcatggtgataggcacctgtaatcccagctacttgggaggctgaggcaggagaattacttgaacccaggaagcgaaggctgcagtgagcagagattgtgcctctgcactacagcctgggctatggagtaagactctgtctca

SEQ ID NO: 89542 - DNA, 1357 bp, Homo sapiens
gacggtctttacaagcgactcgtgggcgtcaatactgggctgagtttgtggcgcgcttagtgatgggatggccctgtgcaggacgccgacacgaaaagatgaagagttcaatccgtgctgtctgaactcacagtgtagcaggcgagatagacgggaagatcggtagggtgggagatgccggaaaggcttcccgtgagactggataagaaatcaaaaatctggtgaaattgccggcaagagggagttaaggacattccaggcagaggcaagttggtccttgctggctgatccagcttccccgtcagcatatggtgagcagttcggtgagaggaccacacttccaatactggcagatgaagccagatactcctctatgaagttaaatgactggttcagtgttaacactgctagtgagcgacagagatggaatttgaacgcacacctgtctgactccacctcgtgttccttccacatggccagcaagctctgctgtcccacctcgcacttctgggaggtggctactccctctttccacccccttttctggatcttgacaagggattctaccctgccccagctgtcaaagcctgcagcagctgccaaaaaacctcaacacaggcatactttggacctacatcatgtgttgatgtcacagatgctgtaccaggcatttgactccttgatctaaagccaggattcctagccaacatggcgaaaccctgtctctactaaaaataacaaaaattagctgggcatggtgataggcacctgtaatcccagctacttgggaggctgaggcaggagaattacttgaacccaggaagcgaaggctgcagtgagcagagattgtgcctctgcactacagcctgggctatggagtaagactctgtctcaaaaaaaaaaaaaaaaaaaaaatagtgagggggatgcatgcccacacaaaggaatcctgatagaggaacaatggcttggtccgtttcccctcctgtgtagcactgtgataaaggaaagcctttcaggtatgtgcctcgatggagccagtgggtggaagaggaagggcaatgagaggtttgaggacaagctgctgataccctcatgtgtcatcacagtggtgccctttgggagcctgctttggtatactcgtccactcagggaagaggaagtctcttatccacagttttgtcttcaaaattgaaatttctttgggcagagcctaaaagagagttgcctcatttcgtgtaactgtagcatatgtagtgtagaggctccaatgtgtttttgaggcaatctgagagctctttctggaaatccctggcagatgacatctgcgtctgattttactttgtcttacaaccag

SEQ ID NO: 89543 - DNA, 418 bp, Homo sapiens
gttgtgtagtaagggtaacttaataagaaagtgttaaaatgcaaaatagctctactattttatgttcccatcggctatctatgatagttccaggtgcttcacattctcaccatcatttggtattaccagtcatatcttcctgatagtgtctgttcaattcttttacccatttattttatactgttgtcttactttctcaacaattagctttctattccacacacaagtcctttattggatgtgtcttttgtaaatattttctcctaagtctgtggctcattttttcttcctttatttttttgagacggagtctcactgttgcccaggctggagttcactgccatgatctcggcccactacaacttctgcctcccaagttcaagtagttctcctgcctcagcctccccagtagctagga

SEQ ID NO: 89544 - DNA, 270 bp, Homo sapiens
agaagatacaaataaatagaaaaacattctaccttaatggattagaagacttaatattgttaagatgttactactacctaaagcaatcccagatttaatgcagtccctataatcatgaatccgataagcagtcatcatccaggatatatagagaactcctgaaattcaacaacagaacaaccaaacagccctattcaaaaatgtggaaagaacttgaacagacatttctccagggatgatacagaaatggctaggaagcacatggaaaga

SEQ ID NO: 89545 - DNA, 121 bp, Homo sapiens
agccggaagtcagagtgcatttggatgctcatgtgtgtgtccccaacttcagcccatcattttttctttctgttgccttcattcactccttcatttggttattcagccattcaccaaccag

SEQ ID NO: 89546 - DNA, 337 bp, Homo sapiens
gggctgtctagataaatgtggaaattattggcatgtagattgtaattaagccatgagaccagatgagggaggtattcagaaacaaagaaaaggtaaaatgattgagctctggactcccccaggattagggattagggatatgagaaggagccagaaaaggagcctaagaaaggagtggtcttaatgcaaagaggaaaatcagacaagttcaattccctgggagtcagtgaagaaaaagtttcaaggaagatggcatagtcaactgtggtcaactctatcaaaagctagaataagatgagaactatgggatttattgtcttttagtcacaaggtaatt

SEQ ID NO: 89547 - DNA, 458 bp, Homo sapiens
gaggcactggagggttttgatcagaggaggtacagggtctggactacattttcaccagttcatgctggctgttgcatggaggagatattctgagaagaagcagagagactactcaggaggttactgatgaactccagccaagagatggtggcaccgtggaccagcagaattgtgtaggagaaaaagaggcatcaaggacaacgtcaacaactgtggcctgagtaactggaaggagatgggaaggcagtgggagaagcaggttggggtagaatatcaagagttcatcccactgaaggcagttaagagacagtgggatatgcaagcctgaggttcaaagaaaaggcccaggctggagaaggtgtcagttttgagatggtttgaaggcatcaacaaaaaacagaccaggtttgaggactgagccctgaggctctctcacatttggaaaccagaggctgcta

SEQ ID NO: 89548 - DNA, 943 bp, Homo sapiens
aaaaagtatagattttgaatgagttagtatatctttgagaatataagcgataagagtacttaaaagttaaaaaagagaaagaaataccaaaataaagtgcctagctcagtattcccatcagaaaaggcctttgtgaaaccagaacacatccagaattggattagcacaataatgtttagtttcaacccatgtcatgccaagactacctgagacagctgggtgacactcatctgcagagagctagtatggttgagtggctagtgaaaacaatcccggtgctaccatttgctaactagaattatttagattttcttactctcagttttctcattcagaaagtagcagtgccagcctcatggttgttgtaagggttccttgtattcaacatgaagtacttagcagcatctggaatgtagtaaataataagtggtgctattatagatgctatagctaggaccaccaggtgggaactatcgagtaacagattgtgagtgtatgctaaatctttaaatacttctctcagtgatgtccaaaatgtcatgggttgccctgtaagtccggtttttcttatcactaaaggatgagtagctttaatctacttggcagtcacaacagatgacctagaatcacagatgattaggtatggaaggcacattggaagatacctaggatgacctgcttgcagaagaagaaacggtaacccaagattgtgggtcatttacccaaggcaacctggatggaagtggtgagccttggactagacccaggtctttcaacttaaaggccaatgttctttgctctgtattacatttccttccaaggaacttctaaaatcctgtttcctgatattctgtttttactctttagacacacatctgttcttttaaataaggtgtttttaaacaattcaacaagtgtttttaaaagaacagatgtgtgtcta

SEQ ID NO: 89549 - DNA, 406 bp, Homo sapiens
ctagaggatccccgttgtctgctctggaaaataaaattgacctagtcaacgtggaaaactgagtactatcaacactgttggcaggagatcataatggtgctctttttgtagtgataaactcttctcacaaaaacagatactctgaaagaggtagggtgagatggggtgaaggtgatacaagaataaaatcttataagattttgtttttgaaacaactgatggcaaatacaaagcttctactgaattcactcagaccatgcctaatttatgcatacagtattcacttttatgcagtatctttaaattttttttttttagagttgggggtctcgctatgttggccaggttggtcttgaactcctggccttgagcaatcctcccacctaggcctcccaaagtgctggga

SEQ ID NO: 89550 - DNA, 303 bp, Homo sapiens
  misc_feature (62)..(63): n is a, c, g, or t
  misc_feature (71)..(71): n is a, c, g, or t
  misc_feature (97)..(97): n is a, c, g, or t
  misc_feature (205)..(205): n is a, c, g, or t
  misc_feature (218)..(219): n is a, c, g, or t
  misc_feature (235)..(235): n is a, c, g, or t
  misc_feature (246)..(246): n is a, c, g, or t
  misc_feature (268)..(268): n is a, c, g, or t
  misc_feature (273)..(273): n is a, c, g, or t
gtgaagtacagtttagaggagaaacatctactatcagaatgtacttaaagagaccaatcttnncacctctntgtagtaaattggatgtttacattgncatgagggtatctctcttggaagaaagaaattattctttattctgaggtcagttatagacagtttcagctaaaaattatgaggaactgattggttatgtctaaaactntgagttgggtttnngatacttgacttgttntgtatattcgngactataattaatagcatctgnatggnaggtaagctatgttatccattgtgaataca

SEQ ID NO: 89551 - DNA, 276 bp, Homo sapiens
gcgtgacaccttagaggagggagggaaagtgaggctcggctgggccatctccatcagtgatcatcaccacagctcggaccggtgagccaagcatcctgcatgcactcatgttgcatcttcccagcaactatgaagtggggaccactgatatccacaaggagcctgagccagagtgcggaagtgatgtgccagcgccacccagccaggaaactacagagtcaaacccaagactcagacctacacccctgctcatagccacctgccacaccacccgcc

SEQ ID NO: 89552 - DNA, 5263 bp, Homo sapiens
tttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctacctttttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagacggagtcttgctctgtcacctaggctggagtacagcggcgctatcttggctcactgcaagctccgcctcccaggttcatgccattctcctgcctcagcttcccaagtagctgggactacgggagcccaccaccacgcccggctaatttttgcatttttagtagagatggagtttcaccatgttagccaggctggtctcgaactcctgacctcaggtgatctgcccacctcggcctcccaagtgctgggattacaggcgtgagccaccgcgcctggccgaggctgctggaatcttccctcatttcattatcccgttatgatggagcaggatccagagagcacccaatttacccagacccagcgagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctcaaaaaaaac

SEQ ID NO: 89553 - DNA, 1527 bp, Homo sapiens
gctttctcttttgggaaaataaaaaccaaatactttcaatggatcagcttccaatatccctggtattgatttgtcatttaatgctcggcagccaattctaccaagatataaaaaccatcatagacttttgtttctggcttgtgaagttcccagtggtccacttaaaagccaagtgttgccttaacttcggtttcagggccagtttgaagattatctcattgatttgaagataatccaaagggagaattcagaaaatatcccaaatcaagctctcaaaggttcatttattttgtggagttggttaagccgctcattaactgctctgtccagccagtgccctttggcttattattcttttgatgtactggaaactaaaacatgtgaagctcctttcctcttctcttgtaggaagcagtgaaatgtagtggaaagatctaggacttcaaagtccaatcttccttgaatcctgccttaaccacttactagttatgtgaccatggtatttacctctctggtctttcgtccgcttctctgtaaaatagtaataatacttcgtggcctagccagaagaattaaatgggataacatatcaataacctttgtattggaacctagcagatacttaataaatggcagttactactattgcatggactgttaacagtccataaagaaaacacccagactttgtattcaaatgacctaacataggattacgttttctaatattcttcaccattgacagtctgtaaaagaaggtactgtctttttcttgtgcatttttttttcttttacctgtcactgatttttccacatggaagacctaaacagatttcatttgaagataaccatttgccaaatgaaattggtgggggaatttttcttcctttaagacctcctcccacagcaggcgtctggataacaagtaaaatgataaataatggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcagtaatcatatgagataggtgcgattacctaattaacagtggaggaaactgaatcccagagggctaacttgcccagagtaatgcagctaagaagtagaagaatggagccagtagtctctaaaccaccttcccgatccgcctcctcgtagttgttttaaaggacaaaacattaaaatgtcattctttttcttaggactttataagagggagagagctcccagggaacttcagtgtttttcttgtttgttttaattattctatttaaatggttcctagacataggtttttatgatccagtggtgcttgctgaggaaaatcttattatgtaaccgcccttttcctgagccttcttgccctcctggatacagatgttttgctttttattaaacttacttgtgatcatgt

SEQ ID NO: 89554 - DNA, 456 bp, Homo sapiens
cggcacgagaaagcttagtttctttcatgttgggattggcaggtagcatcaatattctatgtcgtccaaagttgataagattgttacccttccacatgcttctgaattcagttctactctttgattttctaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacgtgagtatttccttaagatacccttttcttttggtgttctaattttttttttttgagacggagtctcgctctgttgcagtgtgctgagattgtgccactgcactccagcctgggtgacagaatgaaaccccctgtcaaaa

SEQ ID NO: 89555 - DNA, 578 bp, Homo sapiens
gatcagattttttgtgtgttttgtgggtccagacagaaattttaccttatggaacagaattatcccactaccgtcagcgtgccctcctgcaatcacagccagttcgccggacgcctctcctccacaatttcctgcacatgctgtcctcccgctcttctggcatccaggctgtatcccgggaagtacctgccacagagaagggaggtgcactggcagagcggactcatgccagatgtagcaaacaagctgagagagggtgtggcatggcttgcattcagcactactgagccttttctctttgcctacttcctcattcccctttctccatgcattttcctgtctttcccatcattaaatgttgaaagcagaactagaagtgtcaaaggccaaccctttaccttccttctcctaaatgagcctttcttctgtttggttacaaaatgccctgaactctgagagcttgagcagtctcttaatcactgtgactctcaatctccttaccccaaattggagtcatacctaccgtcccccctccccggatacagggtacggagtcgaatcgaatcatggctagtgtc

SEQ ID NO: 89556 - DNA, 4653 bp, Homo sapiens
atagcttgtcactcatgtgcctctggctggttgacattttgcttcccctcactgcttccatgtcatggggagatgtcttttgtaagacaattggtttgtcagctgcactcattcagatatgctgctaattgggagtggaaaatttaataccatgtgattattttgaatctgaggccagttgtcagtgcttcaggggtagagagttgtttcctacctatgaacattgttttccttggatgattgtcagtggttagtttttcttgatttacttggaggttctacctaactgccttgctctaccccctgccccatgctggtccacgttgcagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctcaaaaaaaac

SEQ ID NO: 89557 - DNA, 4204 bp, Homo sapiens
  misc_feature (4109)..(4109): n is a, c, g, or t
  misc_feature (4157)..(4157): n is a, c, g, or t
  misc_feature (4188)..(4188): n is a, c, g, or t
atagcttgtcactcatgtgcctctggctggttgacattttgcttcccctcactgcttccatgtcatggggagatgtcttttgtaagacaattggtttgtcagctgcactcattcagatatgctgctaattgggagtggaaaatttaataccatgtgattattttgaatctgaggccagttgtcagtgcttcaggggtagagagttgtttcctacctatgaacattgttttccttggatgattgtcagtggttagtttttcttgatttacttggaggttctacctaactgccttgctctaccccctgccccatgctggtccacgttgcagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacacgaatgttcatgaacattcgtgtcccataaaaaaagggnatgcttgcatgtgtaatcttactaagagctaatagaaaggccaggccnaacctatggacacgaatgttcaggtaccganctcgaagtgtatctga

SEQ ID NO: 89558 - DNA, 3014 bp, Homo sapiens
atagcttgtcactcatgtgcctctggctggttgacattttgcttcccctcactgcttccatgtcatggggagatgtcttttgtaagacaattggtttgtcagctgcactcattcagatatgctgctaattgggagtggaaaatttaataccatgtgattattttgaatctgaggccagttgtcagtgcttcaggggtagagagttgtttcctacctatgaacattgttttccttggatgattgtcagtggttagtttttcttgatttacttggaggttctacctaactgccttgctctaccccctgccccatgctggtccacgttgcagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacatcagagagagctgcaggtaagagctcgattctatagatga

SEQ ID NO: 89559 - DNA, 614 bp, Homo sapiens
cggcacgagaaagcttagtttctttcatgttgggattggcaggtagcatcaatattctatgtcgtccaaagttgataagattgttacccttccacatgcttctgaattcagttctactctttgattttctaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagcggtgatgcacgaaccagacgatccccatagatgagacgcatatccgagtcctctaag

SEQ ID NO: 89560 - DNA, 526 bp, Homo sapiens
agttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggtaagcagtcgctttcctatcttctgcatcccttgcttttctccttgtatcatttccttgagtcctatagatgttgtggctgtatctggagtgtctgggacccacgcatctgcttctgatctcgccattgcattttcttggaaaatcttgctctggtggcagagataggatagggcctagcagtatgagtcagttggctgcgctagctctatttcggctaagctcaaggttctggctttagccttgaaaggagagtgtagattaggttagagaggcatgaggagatggaaccattga

SEQ ID NO: 89561 - DNA, 5075 bp, Homo sapiens
tttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctacctttttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctcaaaaaaaac

SEQ ID NO: 89562 - DNA, 4566 bp, Homo sapiens
atagcttgtcactcatgtgcctctggctggttgacattttgcttcccctcactgcttccatgtcatggggagatgtcttttgtaagacaattggtttgtcagctgcactcattcagatatgctgctaattgggagtggaaaatttaataccatgtgattattttgaatctgaggccagttgtcagtgcttcaggggtagagagttgtttcctacctatgaacattgttttccttggatgattgtcagtggttagtttttcttgatttacttggaggttctacctaactgccttgctctaccccctgccccatgctggtccacgttgcagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctcaaaaaaaac

SEQ ID NO: 89563 - DNA, 3919 bp, Homo sapiens
atagcttgtcactcatgtgcctctggctggttgacattttgcttcccctcactgcttccatgtcatggggagatgtcttttgtaagacaattggtttgtcagctgcactcattcagatatgctgctaattgggagtggaaaatttaataccatgtgattattttgaatctgaggccagttgtcagtgcttcaggggtagagagttgtttcctacctatgaacattgttttccttggatgattgtcagtggttagtttttcttgatttacttggaggttctacctaactgccttgctctaccccctgccccatgctggtccacgttgcagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctcaaaaaaaac

SEQ ID NO: 89564 - DNA, 2223 bp, Homo sapiens
atagcttgtcactcatgtgcctctggctggttgacattttgcttcccctcactgcttccatgtcatggggagatgtcttttgtaagacaattggtttgtcagctgcactcattcagatatgctgctaattgggagtggaaaatttaataccatgtgattattttgaatctgaggccagttgtcagtgcttcaggggtagagagttgtttcctacctatgaacattgttttccttggatgattgtcagtggttagtttttcttgatttacttggaggttctacctaactgccttgctctaccccctgccccatgctggtccacgttgcagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggtaaggaaatgtttctttggcttttgaaaatgtgaagggccaaggagccagataaagcttctccctcctttacctatg

SEQ ID NO: 89565 - DNA, 1518 bp, Homo sapiens
tgcctaattgccctggccagaacttccaacactatgttgaataggagtggtgagagagggcatccctgtcttgtgccagttttcaaagggaatgcttccagtttttgcccattcagtaaacatggaaaaatagcaaattagagacagtgggtattaacaattgcatatatcacaataaatgtatgtttaatctcaggaatgcatggcagttctgtctttagaaaatgtattttttgtatttttatcaatttagagatgcccttttaaaaaaacatattacaaattggaatattcaaagggcagctgttttattttcttccttgctgaaacataaaataatgacgtgttttaaaatttatagaatctttgatttgatcaaatatggtaatgtaatttgccattctaacagatcaaaatcagaatcagtatgatcatctatcttgatttgcgagaagcatttgataatattcaaaatccatttatgaaaaaactcttggcagaggagaaacagcaaagaatttttaaaatataaagggtatgtacaaaactgtagtaaccatcttactgaaagatcaaacttgttccctttcagcttgggaataagacagagcttcctattaagaccaccacatctactcatctttaagctggtgattctcaccaacacatctaagcatgaaagaaataaaaattataagataaaaaggaaagaaaactctcagtacttaaagatgatataattacatagaaaatcaagaagattccatggataggcttcccaaaaaacaatatgtaacataccagcaacaaatggtaagaaaaacacgttgtttttttttttaaagtacattttcagtgacattaaataataaggattcaggaatacaacgaatataacaaaaatgtaagatatctagggatgcgtataacaaaaaaattataaagcttcatttaaaacatttttaaacaaaataagtagaaagtaataccatctttatggaacagagtcagtattataaatgtgtcagttttcttcaactggtccatagacaacacaattttaactaagattccaattgggatttctgtggaacttgatgagttagggccaaaagtaatcaagatattcatgaggaaggataacagaatggcaaaacttgctttaataatttgtgcagggatagacaaatactgtacaccagtctctcaatagggagatcaaaaccaaattcacacagacatgaaaagttgatttatgacagatgatgttgcagtccctggggaaagaatggaaatggtgctagaataattggtttctatatgtatttctatatatgtatatgccattacattaaagtcaatgcctatggagtttgggaggagtgatcaaaatgttctggaattagatgtgatgtttgcacaactctgtgaatgtactaagaaccactgaattgtatatttttaaagcatggtatgtgaataatacctcaataaagctgttataaaaaataaaattaa

SEQ ID NO: 89566 - DNA, 378 bp, Homo sapiens
ggaatcgagctcggtaccgaatctcgaaagtggtgcagggatagacaaatactgtacaccagtctctcaatagggagatcaaaaccaaattcacacagacatgaaaagttgatttatgacagatgatgttgcagtccctggggaaagaatggaaatggtgctagaataattggtttctatatgtatttctatatatgtatatgccattacattaaagtcaatgcctatggagtttgggaggagtgatcaaaatgttctggaattagatgtgatgtttgcacaactctgtgaatgtactaagaaccactgaattgtatatttttaaagcatggtatgtgaataatacctcaataaagctgttataaaaaataaaattaa

SEQ ID NO: 89567 - DNA, 260 bp, Homo sapiens
tagtgataggatcattggttgcctggggatgagggattggggaggactgggagggagggattatgaaggggcatgaggaaacttctggaggtaacgatatgtttatttattgattgtggtggtttcacggatgcatatgtcaaaacttatcaaatcatatatcttaaatatgtatagttattgtaagccaattgtaacttaataaatttgcacttttaaaaaatccaagccagacatggtggtctgcctgtagttacagc

SEQ ID NO: 89568 - DNA, 1236 bp, Homo sapiens
gtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccgcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggccttggctgcctggagggtcagacagtgggtgagagctgccaggagctgcgggagaagttctgggaattctacaaggcagactggtgcgtgtggcctgctgcgcagttcgtgaacttcctcttcgtgcccccccaatttcgagtcacctacatcaacggcctgacgctgggctgggacacgtacctgtcctacttgaagtaccggagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaaccactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaatgctg

SEQ ID NO: 89569 - DNA, 1365 bp, Homo sapiens
gtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccgcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggccttggctgcctggagggtcagacagtgggtgagagctgccaggagctgcgggagaagttctgggaattctacaaggcagactggtgcgtgtggcctgctgcgcagttcgtgaacttcctcttcgtgcccccccaatttcgagtcacctacatcaacggcctgacgctgggctgggacacgtacctgtcctacttgaagtaccggagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaacacacccatgaagatggatgatcatcccctagcccttctcagcaggaacctcatgcgacctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaatgctg

SEQ ID NO: 89570 - DNA, 1156 bp, Homo sapiens
gtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccgcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggccttggctgcctggagggtcagacagtgggtgagagctgccaggagctgcgggagaagttctgggaattctacaaggcagactggtgcgtgtggcctgctgcgcagttcgtgaacttcctcttcgtgcccccccaatttcgagtcacctacatcaacggcctgacgctgggctgggacacgtacctgtcctacttgaagtaccggagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaatgctg

SEQ ID NO: 89571 - DNA, 1288 bp, Homo sapiens
gtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccgcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggcagactggtgcgtgtggcctgctgcgcagttcgtgaacttcctcttcgtgcccccccaatttcgagtcacctacatcaacggcctgacgctgggctgggacacgtacctgtcctacttgaagtaccggagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaacacacccatgaagatggatgatcatcccctagcccttctcagcaggaacctcatgcgacctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaatgctg

SEQ ID NO: 89572 - DNA, 685 bp, Homo sapiens
gtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccgctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaatgctg

SEQ ID NO: 89573 - DNA, 1764 bp, Homo sapiens
gtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccgtccggtgaggacgccacgctgcttagtccttcaccccgggcgacctttgatcccgacacccgactgcgggccgtgacccctgacccgtggcctcagtcccccgcaggacccttgccctgaccgcgcctctccccgggtgtctgtctccccgcagctctgggtctccatcacctcccaacccccggaggtctctgcccactacccaggagcctctggagccgcgcctcctggtggggcttgtagtggaagaatgcacgggtgggctcttccggttttcccggtgaggctgaggctccgggatggcattgggcttacccaggccttagccagggagggagagagggaatggactgaggaacttgccggcccgacccagccccctgacttacactcttatagcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggccttggctgcctggagggtcagacagtgggtgagagctgccaggagctgcgggagaagttctgggaattctacaaggcagactggtgcgtgtggcctgctgcgcagttcgtgaacttcctcttcgtgcccccccaatttcgagtcacctacatcaacggcctgacgctgggctgggacacgtacctgtcctacttgaagtaccggagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaacacacccatgaagatggatgatcatcccctagcccttctcagcaggaacctcatgcgacctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaatgctg

SEQ ID NO: 89574 - DNA, 465 bp, Homo sapiens
caggctggaaagccggcgcagggaggtcacctttgatgtagacatcgtcgtcggcgcgcatgaaccactcatacttgtccagaaatcagcatgagaagatgatcaaaattcatatattgaaacatgaaaaggctctgaatgggttggatgatgccctcccatattgcggtggccaatatgctttactcagtctacagattcaaatgctaatctcttctggaaacaaactcacagacacactcaaaaataatgtttaactagatatctggacatccggtgctcaaggttgaagaagaaataaagaagcacggaagtaataacatgggattatcagaaaacctgactgattgtgctgctgctggcaatggtgatgatggactaattccacaaagagcagaaaacctgaaaatcagcaatttcctaggacggagaatgaagagtatcataggtaagcctatggcaaca

SEQ ID NO: 89575 - DNA, 393 bp, Homo sapiens
tttaagagatggagtctcactctcgcctaggctgtagtgcagtggtgtgatcacagctcactgcagctctgaactcctgggctcaagcaatcttcccatctcagccctctgagtagctgggattacaggcgcaagccaccatacctggctccaagaaccatgatttttaaattgaggaagagagagtaaaagaaagtacaagagtaagttcagttactgtttttcaaatgtttggcattctaccaactttttgttataaatccaagagagagcactaacatacttcttccttcctcccaagtcaaacgtatatactacacccaacttggtaagttctgctctctctcttatggcaaagggaaacactgatatcatttcaaaaaatcattttgc

SEQ ID NO: 89576 - DNA, 291 bp, Homo sapiens
gattttcatcaggcaaatgaaagtaaccacagaaacaattcagtaatactactaagagagattaacttcccactggccttggaatagctaagtgcattgatttttgtgtagttgtgagtttttttctttcattgatattttacgtatttctggggtaaatgtattttttacatgcattgaatgtgtaatgatcaagtcagggtatttggggcctccatcaccttgagtgtttatcatttctatgtgtggtaacattccaagccctctcttctagctttggaatatatagtg

SEQ ID NO: 89577 - DNA, 446 bp, Homo sapiens
aattaactaagtatctgtgaaccatcaaataggctcagataaaataatgagccttcaacaagctggaatataataacattaggactttggagttcagtgggcagttagatgcactaatggcactgctgtgctgggaaaacatatattttatttggaatttttgtgtggaggtgattgcacattatatgaatagctgtgctaaatgcatgaaggttttctgccagcataggaggcgattaaggccccctctgccagataacagctcactggagggaagtaatggtggcaaagtaaaatctgaaaacagatgatttcccatttaatagtccattgactctcctcctacagccactgtggtgatggtgctgctctttattttcatttcacaaagaagcacaaggtattctgagattttttaggtcatacattttctttcaaaaagaaag

SEQ ID NO: 89578 - DNA, 356 bp, Homo sapiens
ggcacactcacgcaaaaataggaagcagtgagccaaactcactttgaaaacagatacaaaagttttaaataaattgcaaattgagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcggcgctgtagtcccagatactcgggaggctgaggcaggagaatggcgtgaacccgggaagcggagcttgcagtgagccgagattgcgccactgcagtccgcagtccggcctgggcgacaga

SEQ ID NO: 89579 - DNA, 426 bp, Homo sapiens
aaaaatttaacatgtattcttcaaaaatcaaaatttatatctgtactttctcaatagaaaatgttttttaagttggattgctcaaccccaacttacatagtattatagtctagtatttcattatatcttacttattttgctttccagattagaaattgttattattgtttatatagtcaacgttagtccagaattatccacgtatttactatcatgttcactcacctccccttctggtatttttcagaccttccctgggataattttccttctactcttaagcacattctttaaaaatttccattaatggtaatgtcctagagataaacaggttatgagaacacatttttactttgttctgcttttcaaaatgctgttttgttgagtattggcttatattcttcatatttccacctcccgctgaga

SEQ ID NO: 89580 - DNA, 420 bp, Homo sapiens
tctaggccttggcatgagtatgtggtcgtgaaggcataagacaaaatatcttgtgtagctgtagcacaggtgctgtggtaagaggaaataggtttgggggcagtattaagggggctaataagcgcagaaaatagtatttgttgctgtcgttagttacttcactttgccttgcctatatgtattgtctgacagcagagccgaaactccagcatccttttgtctcctcctcctcctcctctttttcttattttctgacttataaagatgtatatcttcaataaataagcttgtgatgatatggaaagttaaataaataaaagttctagaaattggaaaactaaatggtgatttcattgtggtctttaaatataacaagtgttataggccacggtggctcacacctgtaatcccagcactttg

SEQ ID NO: 89581 - DNA, 1388 bp, Homo sapiens
cctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatgg

SEQ ID NO: 89582 - DNA, 209 bp, Homo sapiens
ccacgggactctccagcagtccaccccgggggaggaggacctgggcctgctgctgtgataatgtggctgtttgtcaagctgtgttgctgtctctggcccacggcccaggactcacaggcaggaatggctgttttcctcctgccgagttggtgtgtagtggagtttgtggatagtgtgctgtgtcgcactttgttttggaaaaatccagg

SEQ ID NO: 89583 - DNA, 557 bp, Homo sapiens
aggaaagtttcaaggattaaagggttaatgtttatgaacgattcaaattgtcttcagtgaaacacattagtcacaagaatccctgattgctgcactttaaaaaattctttaccttttccttgagcagattggtccagtccctctgctttctgttctgtctacattgtgtattatttattactatatagtatatgtatctgcataatgtctgaagtcattaatgcagtaacaggtcaagctctttagcattctttgacttttcccaaaatatagatatgacattctcctttatcttccttcttagatggcctaaatctgtctcttcatttacctcaaactcaaattagtatgccattttcatactgaaaattaaatatttttatggattttataaatattgcaacattttagatattgttttggaccatttgtgtatttatatataataaaatcatcaatttaatacttgtaagatcctaacatgtattgattgtaaaagtgaaatatgtaatagccacacttcactgttttaaaataaaagtgcaatttcaagttct

SEQ ID NO: 89584 - DNA, 626 bp, Homo sapiens
atttccttaatatataaaaagctcttacaaatcaataagaagaagatttaaaatgtagtagaaaaattatcagaggataccaacagtcccttaacaaaaaaggaaataggaaatatttaaaaatacgggacagtgctcagttttgcttataataagagaaatgtaagtgaaaactgcagtgaaaattttatctgaccaataggcaaagatccaagagtttcatctcaacactgacttggcaggaatgtaggatgatatgcactttagtacattgctgtgggaacgtaaactgataggatctctgtggagtgtgacttggcagtatctaccactgcttcaaatacataaccttaggctgggcgtggtgtcttacggctctaatcccagcgcttgggaggcagaggccgggggatcacttgagctcaggagtttgagaccagcctgggcaacatggtgaatccctgtctctacagaaaacacaaaaattagccgggtatggtggcatgagcctgtagtctcagctactcggaaggttgaggtgggaggatcacttgaatccggagggttgaggctgctgtgagccaagatcactctactgcacttcagcctgggcgacagagtgagac

SEQ ID NO: 89585 - DNA, 367 bp, Homo sapiens
aagggtgattatggtgcttaattattcactatattcataggatgtagcccccaaacacatgtcagtgacttcctctggtgctcagctgaagaagcagtgatctgtaatctgtttccatgtgggagaaaggaacggccatgttggatttgcccaaggatggtacatgcatttccctgcaggcttgtcgggggtgactttgaccacttgtggctccctttcatgcgtgactctctggtatctaatccacgagtgaggtgagactccatggtcctgcttccctttcctacttccccacctggtagacacctgctgtcttagtctgtctaggctgctgtaaaaaaagaaaacccacagactgaatagcttg

SEQ ID NO: 89586 - DNA, 259 bp, Homo sapiens
aaactgctgtcacctgtcacaaactctgctggtttagtcaatggaagacactcctcctgggaggtcagacagtagagggcagaaagaatccagcatacttctctcccttcctctctgccttggacagagacatcctagagtttcttccgctgacccctaggctctggtgacaccacctcctcctctttgtttttgttcgttttgttttgttttttgagacggagttttgctcttgttgcccaggttggagtacaatgtt

SEQ ID NO: 89587 - DNA, 927 bp, Homo sapiens
atcccaatggaactctctctgggtgtgggggttgagagaacctaaagcattcagctgcacagagcctctttccagcgatgggaaccagtctcaaagcctttacatctcttcccctgccctccatcactgctgagaaccctgccccaggctggcctgcctacatgacacaaatagcagtggactgtcactcatcagtatctgcagttctgtttaccaaagcctgcttgctagagacgtttcagggcctccttccctcaaagcgtccactgtacctccatctggatacaattagctggctccccacttcctggactgacggtaaccaccttttccaatgaccctgaagaaaacatgcaatctaagctgctttaagagtaacctacaactgaggacaaattttctatcaactcccagtacccctctctgccgtggctgatttgttactggttttcctttttttttttaatttgaaaatgtaagtaattatactaagaccagttcactctgagattgttttattctaatttgtcctaaggacctgcctgtacttagagcctgatagaaagcccaagttgatctactgggcagctctctgggcctggaaggaagagcacacaacaagacttcaacagtgagcctggctaggtccaggcagaccatgatttctgaaagcaacagtatagtccacatggaatcaggctgctgatgaacagcagcgagaggctgcctctgaatcatatctgcagggtcacctgcgcctggtggaggcccacagtcatccattaggccccagtatcctatgtgggagtatccacgtctagtctctacttctcactgcaggagaggtggcagatgaggaggtttcctactttaaagaaagtagaagttgtttcctttcttccctcctcacagccttgagggggaggt

SEQ ID NO: 89588 - DNA, 823 bp, Homo sapiens
gtgggagaaagagcgcaaacaccgagagaaagatgtctacctggcagccatgtcagagaatcaccagtatgtatgtcatgtcactcatcagtatctgcagttctgtttaccaaagcctgcttgctagagacgtttcagggcctccttccctcaaagcgtccactgtacctccatctggatacaattagctggctccccacttcctggactgacggtaaccaccttttccaatgaccctgaagaaaacatgcaatctaagctgctttaagagtaacctacaactgaggacaaattttctatcaactcccagtacccctctctgccgtggctgatttgttactggttttcctttttttttttaatttgaaaatgtaagtaattatactaagaccagttcactctgagattgttttattctaatttgtcctaaggacctgcctgtacttagagcctgatagaaagcccaagttgatctactgggcagctctctgggcctggaaggaagagcacacaacaagacttcaacagtgagcctggctaggtccaggcagaccatgatttctgaaagcaacagtatagtccacatggaatcaggctgctgatgaacagcagcgagaggctgcctctgaatcatatctgcagggtcacctgcgcctggtggaggcccacagtcatccattaggccccagtatcctatgtgggagtatccacgtctagtctctacttctcactgcaggagaggtggcagatgaggaggtttcctactttaaagaaagtagaagttgtttcctttcttccctcctcacagccttgagggggaggt

SEQ ID NO: 89589 - DNA, 136 bp, Homo sapiens
gtccacctgttgttatggaactcttcataccccttgagccacccacactgttttgtaccataagctccaatttttatgaatgatatataaatctcaaaaccctgatgttgaccacaaatgtcctgtgctcatcctg

SEQ ID NO: 89590 - DNA, 187 bp, Homo sapiens
taagagcaaaactccatctcaaaaaaaaagaaaaaagaaaagaaaaagaaaaagaccacaacagagagatagagagatgtggggattgaggcaaactgaagcatgcctacctaacaggacagctcctacacgctaagcagattgtacccacataggaatgcatatttggtgctgccaaatcttccat

SEQ ID NO: 89591 - DNA, 498 bp, Homo sapiens
atttgcctattttttaattatgttgcctttttgttgatgatttgtaagagctccttgtatattctggatattagttacctatcagatacatgctttccacatggtttctcccattttgtaggttgcctttttactttcttgatgaagtcctttgatacccaaaagttttgaattttgacaaagtccaagttacctatttttcttttgttctttttgcttttggtgtcgtatctaagattccattgtcaaatccaaggtcataaagatcgacccctgtgttttcttgtaagagatttatagttactgctcttacatacgttgtgagttaatatttgcatatatcaggtaggtgttcaatatcattcttatgcatgtggatatccatttgtcccagcattatttgttgaagagacaattttttcaatggggcttggatggtcatggcatccttttcaaaaatcaactggccataaatgtatgggttaatttccagcctct

SEQ ID NO: 89592 - DNA, 325 bp, Homo sapiens
ccaccttgcccggccccagtatattcttttttaaacccttagccttatatttgtaaaagtttaaaacagcatacttcatgtgccacattttaggaaactgtctgagatagtgattatatctccatattagaaataagtagaaaggcccagaaatttttaaatgacttgctgaaaatcacaaatctagcaaatgtcatacttcaaccaaaacgcaactccattatgtattttaaagcacctttctactaccactagccaaaaggactctcatcgggcactgggagaatcctacaggataaagctgcttggaaaagattactttggt

SEQ ID NO: 89593 - DNA, 270 bp, Homo sapiens
ttgggaggtagctatcgtgtaatggttaagatcatagactttgaagccagacttcttaagtttaagtcctggctatgctgtttcctacctgtgccatattgggcgagttacttgactgtctgcctcagttttctcatcagtataatggggataatagtatctgtttcatattgtggggattaaatgatttaatacatataaagctcttaaaacagtgcctggtgcacagaaagggctcagtaaatgttgcaatgactggtcagcttattt

SEQ ID NO: 89594 - DNA, 567 bp, Homo sapiens
tttgtagagacaggatctcgctacattgccaaagctggtcttaaactcctgggctcaagtgatcctcctgccttgacctgtaaaagtgctgggaggccatgtgcagtgtacatatgtaatatcagctatccaagtgagaggatagcttgagcccaagagttcgagatcaacctgggcaacacaggaagactccatctctacaattaaaaaattagctgggcacagtagtgcacgcctgtggacccagctactcaggagaggctgaggcaggaggatcgcctgagcccaagagtttaaggctatagtgagccatgatcacaacattgcactccagcctgggcaacagagcgagatgctgtctcaaaaaaaaaaaaaaaaaaagtgctgggattctgtgtgtgagctaccacacccaatctgtattttttttttaaaccaacaatttctctgtctcccattttgagcaaattcccatatttcctaccctatttttcaaagtggtattaatgtctcagatatcctaatgaaatttcagagacaatcatccttgtggttgcaaaaaaaaaa

SEQ ID NO: 89595 - DNA, 851 bp, Homo sapiens
catgcggcaagagcgagtcgcaggaacaagtggggaatcttggccgcggccccctcccccgccttataaaaaagaaattgacttttgtttggagtttgtgaaaagtggggctcggggcccagtcaatggggcgccccgcggcgcgggctgagtggagctagcgcgaaccgctcagccgcggccccaattaatccgccctttgtgcggcccgcccggccgcccccgccggcaccgcaccagcggcccattgtttggcctcgccgggccgcgggatttacccttttcaaacagccggttttgtccagggcagttcgagcggaagtttctcactgacaatttgccccaaatagatagatttgtcagaagcgacttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctgctgagccagacactccgcggacctgacctccgttttacccatctgtaaaatggagcagctgggcgctggcaagccgtaagtccaagagctttggctccaccagcgtgtacgacgctcatttcctttctctctccccacaccctttccaaaaactgtaagccagaaaacctggccaggcctccgcgacggcgagaaacggtcttgaaggtcggtcggtcgccgtaatgcggtccggatcgtgcacgtgctgtttcgccactgccctccggctcctccttaacaaagatgtcaaccgtgctaaatcacaggtggtgcctttgtaagaccagctattgtccc

SEQ ID NO: 89596 - DNA, 309 bp, Homo sapiens
atcctgaatctgcatgtactttacagcaacacttcaaaatatatgaaataaaaactgatagagctgaaatgagaaatggagacactcacagttatgattgcatattttagcaagcctccctcaataacagaacaagtagagaaaattaaaaggatttacaatcgctaaacaaaataccatctaccaactgaaactaactgatatttataggatactccatgcaataatagcagaatacaaaatgttttcaagcgcacataaaacattcaccaagctaggtcatatcctgaataataaaacaaaccttaa

SEQ ID NO: 89597 - DNA, 414 bp, Homo sapiens
tccatgttcatcccaaacttcctccctcaggacctcccaacaatacacatttccaaagcctcctacaatagaggccaccaaactcccatgtacaccaaatacccatgtcctgacctcaaaaccctttcctaatgaactcaaatggccatgttcccctacacagtctccctcaagacagaattagtgtgcaggtgtcagccccttgtgatagacaagcagaggaagagcagcagtggatctaagaacaggtaaatgtccactacatgtcctaattgtgtgggcttggcctccaggatatcatcttcttcctgcacccttgactttcaaggaaggaacaaatatggagaataaaggggggagccataaggaggacgaggaagatcttagggacctagaaataaaaacagcaccttc

SEQ ID NO: 89598 - DNA, 1282 bp, Homo sapiens
cactttgctctgacccatagtatactctttgcccagtagtgtatggttgaattcatttttgcttctttgctaagaggtagttcgacaccttcttgcttctgagtttattcctatttcttcccagctcttcaaactttaagaaactgaagagggcagcaaagtaacctggccatcttttatcagggcagtcagaggcacctgactggctgagtggcagatagattaatggaggagctttgttgctgtattgcctagtttcatcctcttggactcttttcatatacttgaatagcctaattatctgaagccagaagtgagttgacagtgccagttagtggtggcagtaattatgactgaaggtatctgtgagcattaaagcattccattcagtgacatgaatgaaacttaccctagctctttaagataaaataggtgtaatatctcaataggtattctgtaagacgtaatagtagccctagagttgatggctgtgtttttttctacctctcagaattttaatgcatcttccttttagattaaaaaaaaaaggtaacttgggaagcttcaactctttgaccacagctatataagttattttttaaaacaaaatactttcaagtttatttactcactaaaaatataattatggtcaagacatttcttttcaataggttagtcattttcttgacgtctattttttttaacttgagcctgcataaaaagaattaaaccctgaagaagtattttatgtcatatctgctttcaccagattgggtatagttctgttttttgtttgttttttaaaccttaagtgttctcagtgttttcttttcacttaagacgtaggtgtcctagaggaaaatgctaattttaaactgattctaaaattgttattttaaaatagtaaaaataacttaaatacagattttggtacaactaggttctcccaagagtaaggtcttctaacatctaataagctcattgatttactactattaggtgaatgcatatactaaataagttccagctaagtcaggtactacttccaattcagtgttcttctttgaccatgcattaatgcattatcagtaaaatgtagtgatctcaagcagccagaagtcttcattgtcattagcacaggcatttggatgcttcaggcttattgaaatttatctttttatggagacctttaaagaacattctcatacaccacttattcttaatatcttttaaactttaaggattctctattgtctggaatgtggaaagtagacctgggaag

SEQ ID NO: 89599 - DNA, 1272 bp, Homo sapiens
  misc_feature (1013)..(1013): n is a, c, g, or t
  misc_feature (1261)..(1262): n is a, c, g, or t
gttgagttcttggcacagctgaagatcatggactacagcctgctggtgggcatccagacggaccgggcagagaggaggagatggagagcagacctgtgtgcgcgccccgctctgccacgttccctgaggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacaggacccccaggaccccgctcccattctgcccttgctcctgccaacctgtcttctctatgcccatgactttggaaccctctgccacaagtgccagcccccacatctgtagcccctgcaggaacaagccctaatctggactcattgcaatggctcagcttctcttccaacctgtccataaacctccaggcagagatcacaaaactaacagctctttctgcaaatctggactctctcctgcaccttcttcaccgtccaggcctccctgtcatccgtcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcacagccagctgctggaggtcccagaggacgggtgactcagcaggaatgggggagtctgaggggttgacagagtgcccaattctcacctcctcctgcaccttccagagagacgggctgcagggagtgattgagtggatgaacatgactagagggacccagtcttctcctcagcagctgcttgaggacagtattagcggtcccctcaatcccccccccnacacatgcacacatgcactgacctgcaggggccagatcccggtggacccggacacagcttccaggggctgtcttgccatgtcccttcccagatctgcctggattcatgccaggccaccctccacaatttgctgagggaggccccagagtccagggcacccagagtgctaactagcccctgggggtacagggagaacagcatgctgtgtgggggatactactctctgcccatacctagggcctgtgcgnncacaggcagc

SEQ ID NO: 89600 - DNA, 329 bp, Homo sapiens
aacaaaaactgtagaaatcagtaaactgttgagttgtcaccaacggccaccttttctactatgtggagaaaaagaatctgagaatgaagaaagcaaaacgaaaaaagactcacaggccaggcgcggtggctcatgcctgtaatcctagcagtttgggaggccaaggtgggatgatcacttgaagtcaggagttcgagaccagcctggccaacatggtgaagctccatctctactaaaaatacaaaaattagctgggcatggtggcacacactggtaatcccagctactcaggaggttgaggcaggagaatcgcttgaacctgggaggtg

SEQ ID NO: 89601 - DNA, 618 bp, Homo sapiens
gttaaaaaagttaaaattcaattgacaaatattttgttgcaggaaaatatgacacatggtcagtaaaagctttcaagcataaaaacatattaagataaagtaacattttgtgagaggagtagaatataacttcaaggagaaaaagcaatgatgtaaactggccaagtgcagtggctcatgcctgtaatcctagcactttgaaaggctgaggcggaaggatctcttgagctcagaagttcgagagtctaggcaacacagggagacctttttttgcagttcagtagttttgtggggaacaggtggtgtttggttacatgaatgttttttttttttgagacacagtctcactctgtcacccaggctggagtgcagtggtgcaatcttagctcactgcaacctccgcctccccagtccaagtgattctcctgcctcagcctcccgagtaggtgggactacaggtgcgtgccaccacacccggctaattttttgtatttttagagatggggtttcaccgtgttagccaggatggtctcgatctcctggccttgtgatccacccgccttggcctcccaaagtgctgggattacaggcatgagccattgcgcccggccctacgtg

SEQ ID NO: 89602 - DNA, 504 bp, Homo sapiens
acctaatacagtggagggtttcttttacatgcagatgaaagcagtccttgtgatacagaaacaaagtattacagaccaaaaatatcagaataataattttggcatttgaacacatgttcctaatttcaaaaggtgatttttttcttgagttggtttagtttagagagtatttgctttcactgagctttcataagagttaatttgtttacaggcagagatgagataaatcatgtctttctttagcctgtttctttatctgtttctttttttctacatgaattgcacatacttctttaaggagtcttataattaaaacatgttaaatgagctcaaatctttttccataattaggaacttgaatcattgcctaatttgtaatttgataagtaatgtgtatttgttgaatttttctgctatcaatgtaagtcctggggtaattttctaaaacaaaataaaaatggttttggctctgttttcttaacatattaacagtagtctaggaaa

SEQ ID NO: 89603 - DNA, 499 bp, Homo sapiens
attcttgtcaagatgaaaagcattaattcacactgcaatcaggttgccttaacataaaaaaaaaaaaaaatccatgcagttaaatgtaaaaattgaaaaaaaaaaagacttgggaatccctgttcatctgtttctcagggctgtcactagcagcagcaccaacatctgtaaaaatagaaagtgaggatggtggacaattatttttgacaaagtccttccataccacctatcctcttgttcttacgcttcctttcttttcaatttcctcttttgccttttgcctccatatgttttggagtagctcctgcccaatgcaaattagatagatagatagatagatagatagatagatagatagatagatagatcgataactgtggaattttcataatattaaaaattatcaaaattttatttgcatgttttaattttgctttgctttatttttaccatatcatttatctaatacaataaaatgttcctttcaatcactgagcag

SEQ ID NO: 89604 - DNA, 885 bp, Homo sapiens
caccctcctttcccttgcgcttgctctccggtacctgttcctcacctgagctcaagggcagggagaggccgggcctctggcagtccacgaaggaagccgtctgccttcggttatgattttaggaacaagtccaacgagggtgttcaagcagttaatggttgtgctaactcttgtttctactgaagcgggttttgcaaagctgacatcccttaaagataacttgggctttcggaagcggcaaggaaatggcacctgtagttgccaggacaggtggtgtcctcggccaggactaagagccagctcatctttgtaacattcataatacgggaaactgaggaccaggtggctcggaaaagagatgagttccagcttttacctaacacagggttctctcgtcgtcccccaacccctccagctcggcttctttgtgtccagggttgtagatttttggatagaggtgtttctgattctagtgagtctgagaactggaaaagaccaaggaggggttgatgatttacaaggtccatagaaaaactttttgtgtggtcggaagttggccaagcagaggcccacagcctgatgctactgccccccacccccccaaagatctgaattccctaaagatcaagagggttcagctggccttgggagatgtttgctggagaatgacttcagttttctcctaaggcaatcagattgcaaccattagcattgtatcttatctgcaaatcagtttactccgaggttccccaaggatagttttattaggaccacaggactttactaaccactgaggtaacacgctgcttgtgcagcaattattttgaggtggaggtatttatgggacaagtttataattccatttattaaagggactaacctaaa

SEQ ID NO: 89605 - DNA, 431 bp, Homo sapiens
aattcttcgtagctcgtataagaggaaacatattatttgtttttttgtgactggcttatttcactcagcataaggtgctcagggttcatccgtggtgtagcatgtgtcagaattcgcttcctttttaaggctgagtaatgttccattgtatggagagaccacattcatccatcagcgggcacttgggttgtttccactttttggctactgtgactcacgttgctgtgactaagagtgtgtaaatatctccccaagtccctgcttcccattcctttggggatttacccaggagtgagactgctggatcccatggcaatcctgtgtgtaatttgggggaagctctgtgctgttagatactgatctttcccacctactatttctgccacaggcagcgcttgctccactcctgaagcaggcagggacgctgccca

SEQ ID NO: 89606 - DNA, 752 bp, Homo sapiens
  misc_feature (749)..(749): n is a, c, g, or t
  misc_feature (752)..(752): n is a, c, g, or t
actgcctgcagaaccccagcccgactttccctgcgcactgggatcctgctggaacctcagctgcaacatgagctccgcagccaggtcccgcctcacccgcgccacccgccaggagatgctgttcttggcgttgctgctcctgccagttgtggtcgccttcgccagagctgaagctgaagaagatggggacctgcagtgcctgtgtgtgaagaccacctcccaggtccgtcccaggcacatcaccagcctggaggtgatcaaggccggaccccactgccccactgcccaactcatagccacgctgaagaatgggaggaaaatttgcttggatctgcaagccctgctgtacaagaaaatcattaaggaacatttggagagttagctactagctgcctaagtgtgcactttcaatctaactgtgaaagaatcttctgatgtttgtattatccttcttatattatattaacaaaataaatcaagttgtggtatagtcaatctatttcttaataatactgcaaaaataatgctgacacatcacaatttcatattttaaaatttccagaattttaagcaaaaagcattatgaaggaaggcttggtttaataaagactgattttgttcagtgttatatgttagctgatacatatttgttcatttatgtgattgcagtactttatagctacatatttaccttgaatgttacaattagcttgccaataaatattagtagctcttaagcattactcganagn

SEQ ID NO: 89607 - DNA, 2732 bp, Homo sapiens
  misc_feature (749)..(749): n is a, c, g, or t
ctggctgtgctgttcatctcctagatgaatgggatggtctacattcatccatttggatttggccaaagacaccaacacccctttctccctctacataagctgcactgcatggttgctgctggatgtgttgtgttcctggcttccctctggatgctgacagaaacaaggctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcntcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaggggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcaacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttctgagggctgttctcccccgggaaccatctgtccccaccttccctttcccagagccctcttcagggaagccacaggacttagacccagctcaatcccacaattgggaaggggtcatggagtgagtgtgcagagagtgagtgaggacataaggaaggacatgtcccactccatcccccttcctgctcccccatttcctaactcccccagtgtgaattctcagggtcacttctgcctcctcccgtttcccctccacatccaaacagcaccctggtcctctctatcccccctctcctggggtccctcacatgccccttcccttctgttgtgggctgcacaccaaagcctcctcccctccccacttcctaggcactaggatctctctgtggcttcccctgctgggtggtgtcacctctttctctgctttcagagaaacccttcccgcctttcctcagagtgcttcccaaactgaggtcccatggcacactgtcctgggaggcgttcagagggttccatgatggactaggtttggaaccactgggttaaataaacttagagagggctgtttaga

SEQ ID NO: 89608 - DNA, 616 bp, Homo sapiens
ggctgtaccggctggagtgttgggatcaggaccatccctggagggggattcagcaggctcgatcggggtccaggtgctggtatttttcattagcctccaggggattctgatgtagccagcagcgtccttggacaacagtttgagatctgctgcttttcaaactggattccttggagcgctggaaatctcagcgatgtcacagggcaggagagggaggttgtggagggaaaattcagacttcccgcccagcccaccatttcaccaggcagctctaaatttatgtgttttataagccaaggttcacacaaaaaagaaaattcgctgggggaaaaaaacagtttctatggcttaaaaaaaagtctgaagaccaccagtctatttcaatactctattttgttgatgaagaagctggtgaccaaagatacccaaagactaagtcagggggatgcaggggtacaggggtgcctctcactttcccaaagtgagatccacataccacagcaaaatgatttgagccagcctgtggatgaacacatttaaaattttatttataaatacatttactgttacatttgacttctctttattaaatacatttgtgatttatttttgcaat

SEQ ID NO: 89609 - DNA, 388 bp, Homo sapiens
agaactgtttcgtcttaatgacttttgagttgattcccaggcatctttgacataaagtcatgtcacctgcaactaatgatgttatctccagccccaacatctgcgttccagtttctaactcatgtcttattgcacttctcagaacatctcgacaacattagataatagcagcgatggttgttgcccctcattttatttctagttccattagttatgttccagtaacgtgtttcttgctcttaggatattcaaaagtacacctgccgagtcccagccctgaggagtgttttcgtgcttcattgttaagtatcttggaggctctcagctggaaataaatgctcttcatttattaaagaagcatccttatatttttaagagtctttgaaaa

SEQ ID NO: 89610 - DNA, 1430 bp, Homo sapiens
ctggctgtgctgttcatctcctagatgaatgggatggtctacattcatccatttggatttggccaaagacaccaacacccctttctccctctacataagctgcactgcatggttgctgctggatgtgttgtgttcctggcttccctctggatgctgacagaaacaaggaaattctgctgaagtgacaaggcaagccagagccaaagcaggttggacccaccttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagagggatcccaggccatggagcaaggagggcccgaatcagtacctccctcagatcacctggacagtgtgagacaaaaagccgcagggaccatccctggagggggattcagcaggctcgatcggggtccaggtgctggtatttttcattagcctccaggggattctgatgtagccagcagcgtccttggacaacagtttgagatctgctgcttttcaaactggattccttggagcgctggaaatctcagcgatgtcacagggcaggagagggaggttgtggagggaaaattcagacttcccgcccagcccaccatttcaccaggcagctctaaatttatgtgttttataagccaaggttcacacaaaaaagaaaattcgctgggggaaaaaaacagtttctatggcttaaaaaaaagtctgaagaccaccagtctatttcaatactctattttgttgatgaagaagctggtgaccaaagatacccaaagactaagtcagggggatgcaggggtacaggggtgcctctcactttcccaaagtgagatccacataccacagcaaaatgatttgagccagcctgtggatgaacacatttaaaattttatttataaatacatttactgttacatttgacttctctttattaaatacatttgtgatttatttttgcaat

SEQ ID NO: 89611 - DNA, 449 bp, Homo sapiens
ctggctgtgctgttcatctcctagatgaatgggatggtctacattcatccatttggatttggccaaagacaccaacacccctttctccctctacataagctgcactgcatggttgctgctggatgtgttgtgttcctggcttccctctggatgctgacagaaacaagggtgagagaaaaggacagtaggagaggagggaaggcgggactgaagaaaggaggggaagggggtagcacagggcaaagtggaaaagcaggtagcgtcctttttttcttcactagggcttggtgaagaccccttcgaggacagctccaggcccatccctgtggtggccacccatggagacagtagtgctgctcagaggcatttagtttttgtttcttttctgtttttgaggtagagtctcaccactgtactccagcctgggcaacaagagtgaaatccgtctc

SEQ ID NO: 89612 - DNA, 599 bp, Homo sapiens
atcagtgggacagactacacatgtgcccttgctgccctgggccgcactccttggtcgccagcatttcttctgactgtccacctagaacctgcactctcactcttgcagatcgatgccacctcgttgattgcagcctctgtgatggctgccccttgtgccttggccctctccaagctggtctacccggaggtggaggagtccaagtttaggagggaggaaggagtgaaactgacctatgggtgagcacagcaggaggtcctgcagacagggtagtggtacaaggtggggggagcaaagcagagggtcccgttctctctgtccatcactgtcttccactagcctgggcccatctctccacttttcctgctctggtttgggcttcatttgctgtcttagtccattttctgttgcttataacagaaatcctgaaactgggtactttataaagaataagaatttatttcttacagttatggaggctgagaagtccaaggtcgaggggttgtatctggcgagagccttcttgctgctggggattctgcagagtcccaagttggcacagggcatcacatggcgaggggttgaggggtgccaggcag

SEQ ID NO: 89613 - DNA, 2847 bp, Homo sapiens
  misc_feature (864)..(864): n is a, c, g, or t
ctggctgtgctgttcatctcctagatgaatgggatggtctacattcatccatttggatttggccaaagacaccaacacccctttctccctctacataagctgcactgcatggttgctgctggatgtgttgtgttcctggcttccctctggatgctgacagaaacaaggaaattctgctgaagtgacaaggcaagccagagccaaagcaggttggacccaccttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcntcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaggggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcaacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttctgagggctgttctcccccgggaaccatctgtccccaccttccctttcccagagccctcttcagggaagccacaggacttagacccagctcaatcccacaattgggaaggggtcatggagtgagtgtgcagagagtgagtgaggacataaggaaggacatgtcccactccatcccccttcctgctcccccatttcctaactcccccagtgtgaattctcagggtcacttctgcctcctcccgtttcccctccacatccaaacagcaccctggtcctctctatcccccctctcctggggtccctcacatgccccttcccttctgttgtgggctgcacaccaaagcctcctcccctccccacttcctaggcactaggatctctctgtggcttcccctgctgggtggtgtcacctctttctctgctttcagagaaacccttcccgcctttcctcagagtgcttcccaaactgaggtcccatggcacactgtcctgggaggcgttcagagggttccatgatggactaggtttggaaccactgggttaaataaacttagagagggctgtttaga

SEQ ID NO: 89614 - DNA, 2118 bp, Homo sapiens
  misc_feature (864)..(864): n is a, c, g, or t
ctggctgtgctgttcatctcctagatgaatgggatggtctacattcatccatttggatttggccaaagacaccaacacccctttctccctctacataagctgcactgcatggttgctgctggatgtgttgtgttcctggcttccctctggatgctgacagaaacaaggaaattctgctgaagtgacaaggcaagccagagccaaagcaggttggacccaccttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcntcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaggggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcaacaggaagcagtggatctccagacgaggtcttgctatgttgaccaggctggtcttgaactcctggccttaaatgatcctactgccttggcttcccaaagtgctgggattacaggatattcaaaagtacacctgccgagtcccagccctgaggagtgttttcgtgcttcattgttaagtatcttggaggctctcagctggaaataaatgctcttcatttattaaagaagcatccttatatttttaagagtctttgaaaa

SEQ ID NO: 89615 - DNA, 462 bp, Homo sapiens
ctaacatatatattgatgcttcaagtcattccagagtcctcaatcttgttaaagtccagaataagaattatgtacctgaaacaactagaggaggttttagggaaattaattgttgagttaatgctaaaatatgtagcacacaaagtaagtgctgaaggaggccaggtgggagagagatttacctttccattactgtgtatattgtggatggcatggggattgccccaggccctgaaggacttttcaactaggcaaactgggaggagatctctcagacagaaattcggcatgagacaaagtctgaaagtgagaaagacatttgggggtgcatgcaggtgcgtatgtgtcaggaaaggggagtgaggaaaataatgcatgtaaataaaataaggcatataaaacacttggcactatgcctgtcatacaggacattattaccctcatgcttatcgtcatcattat

SEQ ID NO: 89616 - DNA, 129 bp, Homo sapiens
ggtataattaattacgttagaatgagatcatcatgcagtagggtgggcttctagtccattattaccaaggtccttataaaaaggggaaatctgggccaggcacagtggctcaggcctgtaatctcagca

SEQ ID NO: 89617 - DNA, 170 bp, Homo sapiens
gatcagaggaatgttattttgttcagccttctggttggttcacagtagtgatagtattgtaaatgctcagagcaatcctacaagaagaaaactacatgagcccccacatgttccccccaacataccccatcacagcaactgaaaacaagagaaatgttagttttctgtgg

SEQ ID NO: 89618 - DNA, 443 bp, Homo sapiens
caaattagcacccaggaactctctacacttccggtgaaagtatacaatgttacaaccactttggagtacaagttaaaaatatttgataaagcagaagatgtatatatctaccctataacccaggaattcaggaattctacacctagatgtataacctaaagaaaccttcctacacatatacaaagaagtgcaaggatggtggttaaaactcttttaaaatagtaaacaattggaaagatctttaagtgtccaaaggagaatgaataaatttcgatatatatatacaatgaaatactattacaagttaaaatgaatcagagctaaatttatcaacatgggcagatttcaaaaacatactgctaaacaaaaagcaaattgtacaatgatatatacagtataataccatttatataaaatttaaaagcaggcaaatgggtatgtat

SEQ ID NO: 89619 - DNA, 382 bp, Homo sapiens
cccaaagtgctgggattataggcgtgagccactgcgcccagctgcttcatggtcttaaaaggctgtaatcaaggtatcagctggggcagcagtctgacatgagggtcggctggagctcatgtggttcttggcaacactcagtttcttgcaggctgtggaactaaggactcaggttcttgctggctgttggctgaagccacccccagttccttgccttcaggccttcccaacgtggctgcttgcttcctcaaagccagcaagggagcaagtccactagcacaatggctgttatcattgtacacaatatacagttgacctgtgaacaacacaactttggaattcacaagtccacttagatgtggattttttttcaattaaagtt

SEQ ID NO: 89620 - DNA, 530 bp, Homo sapiens
ctctgtctcccccggtggacctagcatgctgggcaaaagcagctatcgtttggcttgaggctcatctgttaaagaggaggctggtgtaaacctaagcatgggggcatgtggagatgagggagagggctggccgggctgtttggagtctgggcctgtctcagctctgccactagttggttgcatggctttgagtaaatctgctccatcagaataatgtgggcaagataaattctcaagttcttccaggtctaaaggtctgggatcctagggctgcgcgaacctgttcccacctcaaacctgttcattggtgtctctggagagagatggacacaaaagtcgtcacttggcccttttggaaacagttgagtcaaaaagtcttggcctcctgctcatttttaaccagggcctcacagaaaacagttcgcaatccaactggtacactggcatgaggttgtaaatcctatctgggaaagcaaaccagaaacttctaccctttggtgttcaaaaatacttcatttttcttaaaattg

SEQ ID NO: 89621 - DNA, 1779 bp, Homo sapiens
  misc_feature (312)..(312): n is a, c, g, or t
  misc_feature (1170)..(1170): n is a, c, g, or t
attcaaacccagattcctaggcctgattcccacagtttctgactcgtgaggtgtgcatggtgccccaaatttgtttttctaacaagttctcatgtgacgctgatgctgctggcctggtttggggaccatactttgagaaccattggttcagaacatgaggctgcagcgcgccaaggtttttgcattgttttctattaaggaatagcctataagaaataggtttctagctttttaattttgttaccagcctagactctatgattgacagggtgaccagctgtcccagtttgccctggggcacaggattattcntgctgaaaatgagaaagtcctgggcaacctgggatgaattggccaccttcactattgatccaacttcccaaatgctttgtctacattgctggtatctggctcggaggaagccctgtgggaaaggctgtgagtgtgttgccccaggttccacaggacacttagagtttgggggacacctgccgtcaacgcactgcaacaatctttagggatgttaattgttcctcaggaggcatacgtaggaatcacatccaccttaaacatgcccacttatggcatttgggctcacacagccaaacagctgccattgtctgaagtaacgcatgggctgttgggctcctacggtgtgacagacatacttctctgcatcatccatgtaccagcctgttttcttctcactgcagcccaatcagctaattatcatcatttccatctttcaaaaacaaatgcttaaagatgccattatttaccccagggtcacagatggtaaaagtgacagaaccacaggccaaacacttgttgttttaccatgtgactccaaggagcatgaaatctgaggctcttcatccatgagattttccagccactcacgtcccttcctctgttggagatgaagcctctccagagtggaaggcagtggacctagcttggatcaggatgcctggactttgctcctgcttcttccagataccggctctatgacttgtatcaggtcatcttttaacccctctgagcctcactttccgcatctgtgaaatggacatcataatgtctgccttaccttctgccttagcttgtcttgaggagaaatagaaatgatgtctatgaagctgtcagtaacgtgtgaaagcgctgtccctntgagcatatatgtgttaaaccttctgttattccaaaagagaggtttggcacatcaactcgaggaatatttacttaagtggaggagaaacaaagcaactaaagtagccaaaattagcagtgaacagaagaaaattctcaggaggaaaatggttcttcagctggttttgcaaggattagcaacatgtgtgtcccattccagagcagcaaatcacggcgtaggccctagccattttgctcagggaggactgcgctcttcgggaaaagttctgttgcaagtcacagattataggtgtgtggtagaaggccaagcctgagctgtcacttcctcagtgtcaaagggtctcattacatttcattacagtgattttctttttgctgaaacattaggaaccctggagcactgagccaagatcatggaacagaatcaccctctcctgcatgtttttgtttctgtctcctgcttttctgttctttttccactttctctatgtgtgagttgacttggctgcctgtagcttcatcgtcaaagctggtccacgtgggttcaacttggtgctctcactctcctccagcattgtttttgtcatcaaagctaaaattaaaaaaaaa

SEQ ID NO: 89622 - DNA, 382 bp, Homo sapiens
ggacccggtggcagctgcctgtggtcccagctacttgggaggctgtggtgggaggatcacttgagcccaggagactaaggctgcagtgagctgtgttcctgccattccactccagcctgggcaatagagtgagaccctgtctcgaaacaagcaaaagaactaaaactttggtgaaaaaaaaaattaaagatgatctaaataaatggtaagacattccacgttcatggattggaaagtataatattgttaagatggcagtactccacaaattggtctacggatgcaatgtaatccctttcaaatttacaatgtttttgttgaaattgacaaattgatcctaaaattaataataaattgcaaatggccccaaaatagccaaaac

SEQ ID NO: 89623 - DNA, 518 bp, Homo sapiens
ataaagaaaaatatagaacattcagtctcacccagtggaagtcatgattaacattctagtccattctgtttctagaaaatttttctgtaaatatattacatagagaaaataatgtcctagttttttcactttgcatcataacaagcattttccatgtaaattaaaactcttcatatacattgttttaatggctgcaaaatatgctgtgttgtggacatatgataatttacctaaccattttcccactgttggccaacaacagaatggttcaaattttacattatcttgtatatcacactgagcatttttaggctgaaaattttgctccattttggatcctatcctgaatttttcaaggaacttactttctagttcactatttgatatcaccagttcttggtacataccatgttctttctacacagaagagagaattgcatgtgatactcattctgcctggtttgctcttcctttccctgtctctttttgccaagttaacccactcttttctttcttaa

SEQ ID NO: 89624 - DNA, 433 bp, Homo sapiens
gggggaaagctggcagttacaggcctcacccagctcccacacaaaccaaatggccagtctcactccctctgtgtaccccccagcagccccaagtctgtttctaggtggagggcaagatgggtttgaaaacttgccccaggctatcctcctccccagcttcccccggtggctgcatctttcctaacagtagtacagtatcagagcccagaagctgcccttggtacttgggggctccacttttctcacatgtgtagattcagggaatcaccactgcatcaaggcacaggactgccactcaccacaaagagctccctcgtgctaccctttcagggtgcaccccctaccctgccctccctcaccccctcctgaacaaacccctgaaaaccacaaatttcattcctacaattttgttatttccagaaagttatataaa

SEQ ID NO: 89625 - DNA, 424 bp, Homo sapiens
ctcccaaagtgctaggattacaggcgtgagccactgcgcccggccatattttttgtgtagacagagattcgctatgttgcccaggctggtctcgaactcctgagttcaaacgaggctcctgcctcggcttcccaaagtgctgggattacaagcttatgctcgtttttattcccaataaatgaagagcgaaattgggtgtaaatcatcgatatatttatccttgtaatattctatgtgatgtagtaggtgaaacatatggatgggtgaagatgactctggcaaaaatgcagaattatatttttaatgcttttcattagctagcattttaatggtattttccttttgcctcttattttaaatcagtagttcatttaacatgttaattaaatgtcatataactaagaataaacaccattaaaaactg

SEQ ID NO: 89626 - DNA, 184 bp, Homo sapiens
ttgttgctgccacattttactttattatgattatggaaactaatttttccagaaggcaagagcagggagtagctctttcctttgaaatgtctggttaaatttctttgcacatctcctagcccaacatcaaatcaagtgctaaataatgtctttgcattttactattaaagtcctttacaatata

SEQ ID NO: 89627 - DNA, 282 bp, Homo sapiens
gctagctgagatactcaccctaaattttttttatttaaacctattcataactctcagatcagactcctattaattatatgttttattacaaatttcaggtaaggttggtttctgaattagaataataaatttgaaatttcagtactgaaaccttaataaaggggtcattactcaaaatttaacaagtaaagccatattaatttaaaataatttggaggacatccagtctttcatggtgacaaaatgaaatttatagagtactaatagatatatactgtagcc

SEQ ID NO: 89628 - DNA, 591 bp, Homo sapiens
actgggtttctgagagtaccaacataaggaggaaagagagtcctgtgatttcctcagaggaagaaaagagctatttcgtatgagttgagtgttcagacaatggtgcctaccctctggaaagaccaggctggaagggccgacagacaacagggctaactgtggctccactggtactgaaagtcggcgtcctctagctccatcccccacttcactccaccttgccatctgcgatgataacacaagcaggagggagcggccttgtctgcccatggctcactggcccggtgcaaacacagggcaggcttcttccctcctgtggaaagacaggcccagcacatgccaggcctttgttcccaacctcctccatgagaggccatctccagaggatggggctgcacaggggccctcctccaggacagcagggatgacagcctcgcggtttcctggctgctgcgtcctcggagtgacttggagctctagggttctcccctactcgacaaggggactatgtctccaccaaggagggaagacagtcctgggtgccaccccgtgggctatgaagaggagtggacagaaggactccgcaggttg

SEQ ID NO: 89629 - DNA, 252 bp, Homo sapiens
attgacagagaatttcaaaaggcaggtatcaggctgatattatctgaatgtgtaaataagtctcagcattactaaaagtaatgccttgttgtgtgatgcaataggaaaaggacagtgcctcatacgaactattcttctattaaaaatcaccctaacgttttcaagactttggatctaattaccaacttatggaaaatagtgagaatagtggaaaaagtcaaccactaccacaaaaaagtgagtgactagtac

SEQ ID NO: 89630 - DNA, 303 bp, Homo sapiens
tgcaacttcagagggcatggagagaagggattaacacagaactgaatttctgctgaagttagaggacatctaagaatgcactgagagaacagtctgcccttgaggcagtgcactccccgtcacttacattggtcaagagaagggacgtttgcatctggggtgagacccgaccaagtgcgctcccccaacgtccgggtctggtttctttaatgcctccaaaaatcttgtgacccagccaacagcttcattaaaaaagctgtttcttaggttacacaattgactcatttactaaatatgtttttg

SEQ ID NO: 89631 - DNA, 421 bp, Homo sapiens
tagaaaaagtaccaatatcccatgctccaatagataattgatagaagaaattctaataatcaataaacaaattatatttaacttcacagtacttaaataattgtaatttaaaatgtactaagattataacctatcaaaaaaaatggagattgttgttactgattaacaccagttgttggtggcacagtgaaatggccagtttcttgtattgctagtgggagtgtaaattggaaaaatctttctagagagcaattcagcaatatgaattgaatctcaaaagcatttatacctcttaatgctattatgctctcaggaatttatagcattgacatgatcagaggtgcatatgaaaatgtagatgcaagaaggtttatcaaagctttgtttgtaataaagaaaaattgggcctagcaaagtggct

SEQ ID NO: 89632 - DNA, 465 bp, Homo sapiens
agatctcaccagtgcagtacagcgtgggtgacagagcaagtaagtaaagaggaggtttggaattagatatttggtgtatgaatgaatgggctaaagtgcaaaagaacaggcagaataactgagctggtacagaggaaaaaaatcacacttaaaatctaaaagtatctgcttctcaatttgggctttcccacttagcagctttgacaccttagaaagaacacttaacttacctgagcttctattacttctaaaaagtgcataaagtgcaggctaagacatagtttttttggcaaaattcagtcagactacatcaagtaaactccctaagtctcctagtataattcatggcacaaaaactggggaaaaaacagggaggatatgtttataagttcagtttgggttttttgttgagtgaatgtctccagtcatagagatgcaagtgtagatacacagtaagagtagtat

SEQ ID NO: 89633 - DNA, 379 bp, Homo sapiens
cgggagagagtaggggctggaactggacagaggagggagacgtgtagaacactgcggcagtcccttcccaagaactccttcaacactgactgtttttaggatctgccttgcattgaaccctgtgctatgcactggggtgatagcgaccctaatttcagggaatctgtaggacacaaccaaaaataaaggggctggccaggcgcggtggctcacgcctgtaatcccagcattttgggaggccaaggcgggcagatcacttgaggtcaggagttagagaccagtccggccaacatggcaaaagcccgtgtctactaaaaatggaaaaattagccaggcatagtggtgggcacctgtagtcccagctacttgggaggctgag

SEQ ID NO: 89634 - DNA, 362 bp, Homo sapiens
tattgctattcaagccactaattatgtctatgaatgacaagtaccccaaagtgttctgtttgatattcttcactctttttagttggctaatcaatataaatgctgcgctcagcaaattctaagcaaatagggtgaagatttatagatttagaagttgattttcatacaaatttgtaaatatgcctactgaggcctatgaataattgacaaatctttgggtaaatatatctataaattccgatctccccacactttgaaagaatgtttctatagctttttgcaagtattgcaaagctgaatgatttgataggcataataccagagctggctgctggaattttcaagtatgtttaccagaagaa

SEQ ID NO: 89635 - DNA, 210 bp, Homo sapiens
tttaaagtattttttttacgttacatgctacttcaaaaccttcagcagacttcctagtgttacacactattaaaacaggtgagagaaaagttcaatattgactttttaatgtattttgtattttgggttttgttttttttttttttttttttttcggtacaccggggaattcccaataaactctcgggaaaacgagagaaaaaaaaaaaa

SEQ ID NO: 89636 - DNA, 188 bp, Homo sapiens
aaaccccatatgctcctatccaatcttacactgggaccattgcctcctgttcttgcctgcttcagccactcaacttctctttattccacaagcatctcaagctccctctcgccatggggcctttgcacttgtttcccctccctggaaggctcttgcccacagccccgtgcccagaaaacactactcac

SEQ ID NO: 89637 - DNA, 1332 bp, Homo sapiens
atttttgagctgtggctagacattctttagagccactggaaatattttgaaaactattctagttatagcagagctgctaatattaacgaatatatttgtgtcttcatggtttgtgactattaggccaaattttgtggtatatgttgtcagtctggatctggtgaggtctgttcaacatgaatctttgtgttatcttgaatttagtagtttcaaggtacttaaattcttaacagtttctaatttgtttcaatacatatgggacatggttgatttttttactgtattagaactcttggaagttcttagccttttcaggttatgaaatacctgaaagtaaaattttctaagatttaataagggaagatactattcaaatcattttcttaggatagcatctttacatacaatgagaggattgtacaagcattaatctcatattccaacatccagttacttgatgtgatccaagtaccctggtctttttgaagcagttaaaatctaattaattaactttgggagtcttcactattcaattgatcctcatcattgtcctatttgcatgactccattttttcctccactatatgagttttctttgtcagggggagaggagtgggaagagtcacagaatctcatattcacatcttaattaaattgtgtgaaattagtcttttgtggaaattctgtaggcagtatgattttgaaaagctaaccaatgataattagcattttagttaatactaaatgcataaaattataacccttgaaattaatttggtgctggcagttctggtttagtcatttttaccagtagttagtagtattaagacctgcagtatatgcactttttgagtagctgtcaaataattgtagttgagaaacaacttgtttattctcacaattcagattttctattcagttttgtctcaaatagtaagttattgtgaacaatttaataacggccctcctgttctagtttgcctaatattttagttaagatttagtgttttaacctatttttttaagtttattttttgtattagattttatttgaataagttatgtgggtttagtaattgacctatttattcattgcttcactaattcatccagattagttttaagtgtgtatatgtatttgctcaccagatcattttcttgggaccttgaactgtgaatgttttgtcctaaccatttaatattttctaggtacttgctgcaagttcttgaactattttaccagctttaactttggggctcttagtttcttttctccagattcttgttattttattttatccaaataaatatttaggtgttctaagaaaaaga

SEQ ID NO: 89638 - DNA, 313 bp, Homo sapiens
taacaagaataagtttgtcatgttggagtcacgtgacaaaatgcctctggaataatcaggaagaccttacaaatgtagctatttagaaatccaatttttttaggggagaggggtaccccagaacttaaaactatgttatgtttttagcagatgcctctctgggggttttctttaagatattaaaatgtctcttgagcatttttgttcattcttacttccaaattttgctacttctctagatctgtactgtaagttaccatatgattgtataaaaatgaacatttcagtcagttatgcagttgggcgtacgggg

SEQ ID NO: 89639 - DNA, 511 bp, Homo sapiens
tgcactgaatggtgtagtacttgcaggccaaaacctctggggcacggtatgctggtgtgccataggtggtcttcatcaggccgttgtagttgttgctgttcttgcaggcactgaccagattgaagtcagtgatgatgatcttggagtcagtgcctggatggtggtagagcagattgtgaggcttgaggtcttggtttgtgatgcccagtgcatgcagatactggatgccatctagcaccatctgcagcattcacatggcgtcatgctcagtgaaggaacccttggtgatgatgtggttgaacagctctatgctagcagggatcagttgtatcaacatgtatacatgctcctgcatcctaaacacctccaccggctggacaatgttggcatgacgcacctggtgcagcacgcacagctctgactcccacacctcctacccctcctggtacttgatctcaattatcttggtgtatgctgccaagtggctcagtgctccatgcataccacttgg

SEQ ID NO: 89640 - DNA, 213 bp, Homo sapiens
atgcctggctagagaccctgtctctaaaaaataaatatttttctttcttcaatgataaattaaccttagctgactgtaacatttttattttataaacttttcattttttaaacttttttcttctatttatttttctttatatctcagcttgtttaacttttcagctgttttgtaataacagcttaaaacaagcacattatacaattgtacaaa

SEQ ID NO: 89641 - DNA, 332 bp, Homo sapiens
agagatgacagtagaaggcacagccagctcgtaaatcagcagcattcagggctctggacagcctctctatcagcaaagcaattgatgcttctgccagggaggctgcaaagaagctgttcatcactacctcatttggagacttgacacccaaatggaggctctaacagccaagttcatagatctgagcaaagcgcagaggcgtcaaatctgtgtacaccagtctgctaagtcttcaagggccctgaggggcaggctcttctcagatgctgctctgactctctgaaggcctttacaaccaaaatgaaatgaaataacttaagtcctagctcagg

SEQ ID NO: 89642 - DNA, 275 bp, Homo sapiens
gtcatgcccacctgcctcagttcccctgccaggaccctccatcagcctcccactgcagcccacgctctgcccccccattcctcaggggtccttctacactcagccctcccatggctccccagcgccccccaggacaaactcctggcttccttccttgccttctttttttttttttttttttttattttttttttttttttatattttttataaaaacccctctaaaaaaggggggcgacactaaaagaaaatatgcacacccttatttaaaaaag

SEQ ID NO: 89643 - DNA, 718 bp, Homo sapiens
accgctgcggccattgtccgaccccggtgcggctgaggcccctttgggcagcccctccgcagatcagaattggagacaaccgagccttcggcgggggcgggaggagctgcccgaggctctgggtgggccggaggtcgcgaaatccggagccccccagaggcggtgattctgactcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccaggatttgtctgcctcctgccgctgtcgctaccatctgggagtaagggcgaaagaagacagaaacttccaagaaagaatcctgagtgatgtcagcaagaatggctaagtaaggacctccagaagttctctgccccgtacaagccatgcaaatactgacaaaactgtgagaatcagatttttcacaactctggaacatttattccagcaagcagcaaatgttccccttgcagcaagctaggaaacatttatttaaaaa

SEQ ID NO: 89644 - DNA, 929 bp, Homo sapiens
ttaccccgcgggttttgagcctgctctttaggtaaaaggtctttattttgcaaaactggaaataggcaatttgattgcatgactccttaagttgcaccttttttttccttcagagttcctgaggatcaaggactagtactgacttgtccttaggagggttctttgtccacttgcacaaacaaccaaatcttgtgtatttacccatgagcaggatatcaagtttccaagccagaggtgatcttcaaattggagcaaggagaagagccatggatatcagagggagaaatccaacgacctttctatccaggtaaatgagtgagagtcaggcattaggaatgaatgcagttaatggcacaacttagggagggggagataccctccagcagctggcttgcgatctcctagatctgcataggaggctgaagccatcgcctggccgacaccttgtaggtctctcttcaaaagggtgctcatgctcttgctggattatttttcctctggtggcctctgattcccttcattaattagagatcccttctcttactcattcagaattgaactcccatatttcttccctgaattgaactcccgtatctctttgttgtgttgatctcccccatcttttccttgtttagtcttgctgctttcactgtcagatgccccagacttgtaggaaacacccacaggccttccttgattctctctcccttgataacctgccttcagactatgtgccttgccaccatcttccttccatctcatgttcatgctgctttgactcattacctccctccacagttctgtagtatcctcatctcccagttcctcgcttgttaagtgctgcttagctttaggtctttagcttttcttgcttttctccctaagtgaccctgccttaaggaacctgccttctagcctcctttcttgat

SEQ ID NO: 89645 - DNA, 1031 bp, Homo sapiens
accgctgcggccattgtccgaccccggtgcggctgaggcccctttgggcagcccctccgcagatcagaattggagacaaccgagccttcggcgggggcgggaggagctgcccgaggctctgggtgggccggaggtcgcgaaatccggagccccccagaggcggtgattctgactcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccaggtaaatgagtgagagtcaggcattaggaatgaatgcagttaatggcacaacttagggagggggagataccctccagcagctggcttgcgatctcctagatctgcataggaggctgaagccatcgcctggccgacaccttgtaggtctctattcccttcattaattagagatcccttctcttactcattcagaattgaactcccatatttcttccctgaattgaactcccgtatctctttgttgtgttgatctcccccatcttttccttgtttagtcttgctgctttcactgtcagatgccccagacttgtaggaaacacccacaggccttccttgattctctctcccttgataacctgccttcagactatgtgccttgccaccatcttccttccatctcatgttcatgctgctttgactcattacctccctccacagttctgtagtatcctcatctcccagttcctcgcttgttaagtgctgcttagctttaggtctttagcttttcttgcttttctccctaagtgaccctgccttaaggaacctgccttctagcctcctttcttgat

SEQ ID NO: 89646 - DNA, 715 bp, Homo sapiens
accgctgcggccattgtccgaccccggtgcggctgaggcccctttgggcagcccctccgcagatcagaattggagacaaccgagccttcggcgggggcgggaggagctgcccgaggctctgggtgggccggaggtcgcgaaatccggagccccccagaggcggtgattctgactcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgttagcagccagttagacaggcaacaggaaaactggaagagacatctgggatcagaggcatccacccagaagaaaataattacaccacaagaaaattttgagcaaaataaatttggtgaaaattctagattgaacaccaatt

SEQ ID NO: 89647 - DNA, 813 bp, Homo sapiens
accgctgcggccattgtccgaccccggtgcggctgaggcccctttgggcagcccctccgcagatcagaattggagacaaccgagccttcggcgggggcgggaggagctgcccgaggctctgggtgggccggaggtcgcgaaatccggagccccccagaggcggtgattctgactcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttgagttcctgaggatcaaggactagtactgacttgtccttaggagggttctttgtccacttgcacaaacaaccaaatcttgtgtatttacccatgagcaggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgttagcagccagttagacaggcaacaggaaaactggaagagacatctgggatcagaggcatccacccagaagaaaataattacaccacaagaaaattttgagcaaaataaatttggtgaaaattctagattgaacaccaatt

SEQ ID NO: 89648 - DNA, 396 bp, Homo sapiens
atgactgtaagtttcctgaggtgtccctagccctgcaaaactgtgagtcaattaaacctctttcctttgtaaattacctggtctcaggtatgtctttattaacagcataagaacgaactaatacaaagggtccccaggtaaatctaatgtgcagctaggcttatgagccactgctcgagagatgcaatgctccatcagtgtctctagctgttttatctctaagtaatagtttgaagaactggggaacctgccgtgcttgacaaaaattactctattgatgctctgaaaaaccaccatgtttttatttaacaaagagttttctgagacttcataaatgtaattcacagtggtgatcctctatgtttatgaatgcagaagctactaactagtaacttc

SEQ ID NO: 89649 - DNA, 2797 bp, Homo sapiens
gtcattggggtgcctcatattgccagacaagagctcagacctgaggagagtgactagcttctctgtgtcccaggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttac

SEQ ID NO: 89650 - DNA, 3074 bp, Homo sapiens
gtcattggggtgcctcatattgccagacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttac

SEQ ID NO: 89651 - DNA, 1839 bp, Homo sapiens
gtcattggggtgcctcatattgccagacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgactttgcaggccttaggaatttgggaagtgggcagagggctctggtcttgccagctgcatggctttctgtgacctgcttgccctccagagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttac

SEQ ID NO: 89652 - DNA, 739 bp, Homo sapiens
tctggctgacatttaagccccatgcaagccggaatcttaaggctaagagagagttgtaaatggtcttgctaagtaagcattgaagaaatgcccaatacagagccagtctgaaaagatccggagagtatttttacccctttcgctccaggcatttaaggaaacctgtcaaatcactagttgctcactaaggtgaacagagacttgagtgacgacctatgacaaaggtcacaggtctttacaagaagagtttaataaagtcattaaacaaacaactacaacccacagtaagtagcaacaacaaaccctgaggaagggggagaatgcgatttcgagagttaccacattataatatacaaaatgtccagtttcaacaagaaattatgcatacatagaaacaataaattacagcccaatcacagaaagaaaaaaaaaagaaatagggagtatccttgaggaggcacggacattatatgtactactcaaagactttagatcaactgcctaaagtatagttaagtagctaaaaggatgatgtatgaactaacagaaaatttcaatagatacatagaaattgtttaaaagataccaaatagaagttctggaactgaaaagtacaagagctgagttgaaaaattgactagagggattcaaccagcaaacttgagcaggcagaagaaagaattagtgaacttgaagatataggtcaattgatattatctagtctgaggcagagaggaaa

SEQ ID NO: 89653 - DNA, 466 bp, Homo sapiens
gctatggaaagagggctggtgaaggaatcgttctggaagagaggtgggaggattgcttcagctagggaggcggaggctgcagggagccaagactgagccattgcacccagcctgggtgacagagcaagaccctgtctctaaaaatgaaagaaaaaaaaaagaaatagggagtatccttgaggaggcacggacattatatgtactactcaaagactttagatcaactgcctaaagtatagttaagtagctaaaaggatgatgtatgaactaacagaaaatttcaatagatacatagaaattgtttaaaagataccaaatagaagttctggaactgaaaagtacaagagctgagttgaaaaattgactagagggattcaaccagcaaacttgagcaggcagaagaaagaattagtgaacttgaagatataggtcaattgatattatctagtctgaggcagagaggaaa

SEQ ID NO: 89654 - DNA, 260 bp, Homo sapiens
gcacgagattagacattaaaaacaaactagccaaaataaatttggaaatttaaaaacagtgttccagataattcctcggattaaaaaaaacaagatgaaaagtaaaaacttcttcagcaaggaattatatagagagccacatggcacacctgtgggttgtaaccaaagcagttctcagaggacaatgtatacacttctaagcatttgctagaaaaatccttaaaaagagtgaactacattcaactgccgaatcggcacga

SEQ ID NO: 89655 - DNA, 427 bp, Homo sapiens
acttcaaaggactctttattattacctttggtaggtccagaagtcatttttgtacgtgtggtttttttctcttgcataatcctaaactgacttcgtatgacctttctgaaattcttcaggcaggtctagacactctcagcccctcttgctgactgtggtaagaaagcatccccaggtggacacgtcctgctcctctgtcccctgttcagtaagacacacccccagacctttgtataatgcagacaggtaccagctgtgtgaaatgagtgattaagtgttgattctttttttttttccttcaaaatgctgactccaaatccctatttttttccaggtctatgaggtaagagacccagttcctatccccttattttctctttccctttgccataccttccctatttccagagcaactcccttcccctaa

SEQ ID NO: 89656 - DNA, 470 bp, Homo sapiens
aaaccatctatgagagaagacggggacccagccccagggaaagatggaggtattacggttccagatgtcgctccccggccacgaggactgcgggaccatcctgatagtttacagcattccccatggcatccagatgaggggccttcttgagtcccccactcctggccattcctcttcccaccccgcccacgtcccagcagtctgcccctggatcaaggctgaggatgcccatgtggccaagctcaggcccccaggtcccctaaggccagggccatggagggctgggaatggggaggcagtgccggggcttagggtaagctcttagggctgtggcagcaaaaggctggccctccactcttccctgaaccaaggaagccttcctagaggaggagccatcttagctggacttgttctgggcagaagggcaggcagttcagtgggaggaaccctgcggaggggctggagaagcg

SEQ ID NO: 89657 - DNA, 313 bp, Homo sapiens
gccaggcgtggtggcgggcacctgtagtcccagctatttggggggctgaggcaggagaatggcgtgaacccgggaggcagaggttgcagtgagccaagatcgcgccactgcactccagcctggatgacagagcgagactctgtcttaaaaaaaaaaaaaaaagattaggtttggatggaacaacaattccaaacagtggcttaagcaagagagaagtttgtttctctctcacataaaaactctgccccagctgggtgcggtggctcatgcctataatcctagcactttgggaggcctagaggggcggatcacc

SEQ ID NO: 89658 - DNA, 356 bp, Homo sapiens
tactaatccatcttcataagcctcagccgtggctcctctggagggacagagccaacgtttccatctaagtaacgcgagggaggagggagagatgctgaagcaagattgtcacagcttaatgatacgaaatgctctcaccggggactctagaaacttggcttctgtgagtttcatctgctcacccctgccctgtgtgggctgagggagggactgaaaagctcccctcctaatgtgtcaatggctttgccaggaattgcatcggtggtgtgtcaggcgggctgttgtctggtttctgtgacagagaccctgagcaacactggtttagacaaggtagaattttctttcttcccacttga

SEQ ID NO: 89659 - DNA, 767 bp, Homo sapiens
tctgagatcttgctaaactcacttattagtgctggtagtttctttgttgattgtgagggtaactttgaaaacacaagatagtgagccataaaatggaagcagctagtctgagcctaacaacctgccttggactgtgttgcattttcttcgtgtcgtagtagtcattgggggttacaatcaaactgctcatctgtattgtgagtccctgtagggcaggttgtcccagctacttcctagtgaatcttttttaatgaacctcaggtttccatcatgacctgaacgaatgagccctatgctgcccaccattcatgcttactgagaagtcagagggagatgacaagggagacttctacatgttgtaggaggaagctgaccatagggtccctcctgttgaccgatgtttctccatgggtctctcatgcatctgcatatttttcaagcagaggcactgactgctttattcccaacagcctttccaggaatgtttatatagtgaacaaccttgaaagatagaggtagtatctccttctaaagcaaaggaaaggtttgtttacagccttggaagttagagataatgtctccttctgtagaaagcatacttaactcttcagtgtaaaagctttggtttcttgaagctaggattcttctcctataacacaacctgctgcatgtgcaggtgtcacctggccctctctgcattgtcctatgggaatcagttcaggaaacctatgcaaaaatgctaatactttggttattgctattgcttt

SEQ ID NO: 89660 - DNA, 155 bp, Homo sapiens
tcataaaaacatctgcccagccattagtaggagtagacacgtccttttgatcagcccgccctgttctgtctttctgggtgtactgttttgatgactttaaaagctcccataaaaactaaggcactagcagctggctcattcttctgatgtcctct

SEQ ID NO: 89661 - DNA, 410 bp, Homo sapiens
cggaagcccccagaccatcacggacgccgagcttcgggtaactctcacagtggaaggttcccacgccgaccctaatcccgcttgaagcagccctgagaaacatcgcccattctctgtccatatcaccccccaaaaatttttgccgccccaacacttcaacactattttgttttatttttcttattaatataagaaggcaggaatgtcaggcctctgagcccaagccaagccatcgcatcccctgtgacttgcacatataggcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctgg

SEQ ID NO: 89662 - DNA, 685 bp, Homo sapiens
caggacacacaggccctgtcctgagccccggaggctggtcctaacacactgtggctcattcttggtggcatagcaacctaggtcttgggtgagactgcccaccaggcagtggccaggactgggctggttgtggagagtctggacacaccagcggtgtaagtccaccaggcagcccttttgcctctagtgtgggatttcttctttctttaatcacccttcctcacaaaggggcaggagcagctgccatggtagatttgactacctctgagtggattcaggaccctgacttttagctagatttctaaaagttttccaccttagccggcacggtggctcacacctgtaatcctagcacttagggaggctcaggtgggtggatcacttgaggtcgagagttggagaccagcctggccaacatggtgaaaccccgtctcgattaaaaatacaaaaattagccaggagtggtggcacttgcctgtagtagcagctacttgggaggctgagggaggaggatcacttgaacctgggaggtggaggttgcagtgagctgacgttgcatcactgcaccccagcctgggcgacagagggagactccgtctcaaaaaaaaaaaaaaaagttttcaacttacaacaaacattccttttctgaaaaaagctcccagttcctctccctggtctctaggcc

SEQ ID NO: 89663 - DNA, 257 bp, Homo sapiens
atgtggtaagaatgagagagagagagagagacagacatggatactattcctcaaaatgttttgtactggtcaatttgtaaaatccaaccttaccacagtcttcacatttttatatatgagatatatttcaaaatgtgttacttttatagtgaagtagaagacaagaaatgtcgtgtatagccacactatagtctggggttatttagtgcagggacaaacatccctaaatacagctttttgggcattagtagtatcac

SEQ ID NO: 89664 - DNA, 355 bp, Homo sapiens
taaaattagtttatgaaaacttgaagaggtgttttgttttctccatcaaattcagacaccaatacaaaactatattgcgcccattgtcagtgcttctattttaatctaggactggaagtatgtggcagaagaattaatgaaataaatatataaatccattgaaatagaaaaataagtaaaatgctgtttgtagatcatacaatcttatttttaaaaaaaccaaacacagtacttttacatttgctgaggtgtggtttacttccaactatattgtcaattttgtcaattttgtccattcaggacataggcatgggcaaggacttcatgactaaaacaccaaaagcaacaaaagcca

SEQ ID NO: 89665 - DNA, 431 bp, Homo sapiens
gctggaagatattttagaagtgctttggtttgtagtttgttcattggaatagggataagaaataggagatttttggtgttgaattatgtaatttatttcttagttgtttgtacttctgtgtatatatacacatttaatccaaccaagtaaatacatagcttacagagtttttgcttctggttacataaatgtgaacacaaggtgtctgcctacttatatcaactgaaatggttaatacatttttgtttacttaagcacacgtgggacaagagaacagggccaaagtacagtatttaaacaggccaagcgaagtaaattttttttaaatcaaggatttagacagcattttatacctagttcaagcttttcccccattggtattaaaatgtgttaagtgattagaaatcctgtacaggtttaaatttttaata

SEQ ID NO: 89666 - DNA, 634 bp, Homo sapiens
aaaaagggtcttcttcatccttcaaaacatcactttaaaaaaaaggagacacagttgtagcagtcaaagaactcttggttttgttggggatataaacatgcaaggataacaaaagatgcaataaatactggggaggagagaagcaggagggatttgctttgagcagggaattggtttttctattcaatttattttgcatagctaatacacattcatgataaaaaattgtaaaggtaaaaagacatattacagtagaaagtttatgtctttcccacccataatttcaagacatcaggtgtacctcaaggaagcaaccactattactaccttttggctatccttccagaaatattctaaacatatacaagcaaaaatatacctacctttatccatcatctcagtacctcttcattattaatagaaatcatagaatgctatatactttgccttttccagttggccatataaaagatgttttcatatttgaacacaaatatctaccttattttaaaaatagccactgagcactttcctaatgacagacattcagaatgtttctacctttgcttttatggacaattatgcaacaaataccttatatgtacatcactttacacatgttcaagatatataa

SEQ ID NO: 89667 - DNA, 290 bp, Homo sapiens
gcaaataaggatttgcattgacaggacatcttgtgcttttcaaatagtccgttccaccgagaggttccttgactttggccttcagtcctgacttaatttctttgcttatgggtaaaacaaggaattcctgtcacactgccaacatcaccccctttcttctcaccccaaggagagtgcagagaggaggcgagaccaagcctgcccagagttggagtcttgagacgtgagattctccagctggagccctataaattggactgacaaaagacagattagcaagagaaatgcaa

SEQ ID NO: 89668 - DNA, 467 bp, Homo sapiens
gcaagaagtgagagtctgatttttaacccatgactgatggtttattgcacaaaaatttgttggtgcaaatccagcagattctctgttatttgggactgaaggtcttagctggtcagagacaacaactactgctgttttgagccacacatagatgtttgtagaccctgcttcttatttcctacctgagaccttatgttgagaagcaaagatttatgttttaccaggcaggtgactgagaacctttttcttcaggtagtcgccatttgcttaggagggatattatgaagcttggcaaatttgcttgaatgaatctcatttgtaactttcaggtcaataagcattttatacatttgaagacctgcaacactccctttgtcatatcccataacttctaagtagggccctccctggagaagagtaaaccaaaggaaatctaatcctttaagtcttacataggatatatttgg

SEQ ID NO: 89669 - DNA, 543 bp, Homo sapiens
tgaggctggtcccatgtgtctctatccttgaattattgcatttaacccacgcagcaaccccgggggagggggccatcagcctcatgtccctggcaggagcccaaggtgctgagaggtggggcaatgtgctcaaggtcacacaacagcctggctccaggccccgtgtcgccctggtgtgcccgacagctgcctctgtctttgtcttgccccatcaccttcctcactgtgagctcctccagggcaagggcagggtcctgtttgtctttgcattccccagagcaactggcatagacctgcgctccgtgctaaggacacacactatcctgggggcccacagctcacaccatgcactggaggcaccactttcacaagacagttccccacaaatgcccaccacttgcaggaaggatgcctctcccacagccagcctgcaggggaaggtctccctcagcctccaggattcccatctccggtttctatgcgtgaatcacagtgacagcaatgcgccctcaccacttcccgttgtcctacattggcttggtc

SEQ ID NO: 89670 - DNA, 505 bp, Homo sapiens
aagttacttaattttcttaaactttatttcatcatctgtaaaatagggagaatgcctcatgggtattaaatgagttaatgcaaaaagagagcttagcataatgtctgacatgtaataagtcctcagtaaatgttagccattactaaaagtcaaaaataggaataaaaatgtcaagactaggtatgatcaggtaggacttaaggatgcttacaaaattaacatcttaagggacttcctggtcaagaagagcatctgagcttgactgcaacccaaacagggccagtgcagggaggagggatgtccaaggaggcttcaaccaaaggaaatagatgagggaagaggtctcaatcagagagtggaaatagggcctaagtagtttcagagctgcccataagtgtgggggccccttcagtctaggtcccccgaccacacacaacagtggtcctaaaattcttaaatgagcagcagtcaagggacaccaaaggatgcaaaaccatagcagcca

SEQ ID NO: 89671 - DNA, 932 bp, Homo sapiens
aaaatttacagcaacagcagtttaaaaagacaaatatgttcattatataatgttaaagggattagtctggcaggaaaataccgcaattctaaatatataagcacctaacactggagcacccaaatttataaaataatcactactagacctaagaaatgagatagacagcaacacaatagtagtgggggacttcagtactcccctgacagcactaaactggtcatcaagacagaaagtcaacaaactctagcctgcaacaaatgaacttaacagatatttatagaacattctacccaacaactgcagagtatacattctactcatcagcacatggaacattgtccaagatagaccatatgataggccacaaaacaagtctgagcaaatttaagaacattgaaattacatcaagtactctctcagactacagtggaataaaattgcaaatcaactcctaaaggcatccccaaaccatacaaatacatgcaaattaaataacttgctcctgaatgatcattgagtcaacaaggaaatcaagatggaaattaaaaaattatttaaactgagtgataatagtgacacagcctatcaaaaccactgagatacagcaaaaaatggtgctaaggggaaagttcatagcattaaatgcttacatcaaaaagtctgaaagagcacaaatagacaatctaaggtcacacttcatggaactagagaaaaaagaacaaaccaaactgaaacccggcagaagaaaagaaataacgaggatcagagcagaactaaatgaaattgaaacaaacaaaaacaatacagaaaataaataaaaagctgtttctttgaaaatgtgaatgaaattgatataccattagtgagattaaccaagaaaagaagagagaacatccaaataatcgtaattagaaatgaaatgggagata

SEQ ID NO: 89672 - DNA, 261 bp, Homo sapiens
taatgcatatacatatatgactctgtattgacaggttttttcctatcagcactttaagtatgacgtgttttactatgcatagttttttaaaagaagcctgctgacttccttatctttgttcctataggggtggtctatcttatttctcttaactgcctttaagattttctctttataattagctttcatcaatttgtcatgtgcatttggtgtgagcttatgtgtgtgtgtttgtgtttatcttgcttgaggttcatttcg

SEQ ID NO: 89673 - DNA, 220 bp, Homo sapiens
cttgaaaattaagaacaaagttgaaggaatcatatttcccaatttcaaaacgtaacgcaaaactttggtaatcaaagcagtgtgggctggctggacatggtagttcacgcctgtaatcccagaactttggaaggccaaggagtgaggatcactcgaacccaggagctcatgaccagcctgggtaacatagcgagacctcgtctctattaaacatgaaaaa

SEQ ID NO: 89674 - DNA, 941 bp, Homo sapiens
  misc_feature (27)..(27): n is a, c, g, or t
ccctctctctctctttctgtctttccntctctctctctttctgtctttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89675 - DNA, 5411 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89676 - DNA, 5519 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89677 - DNA, 5884 bp, Homo sapiens
  misc_feature (5534)..(5534): n is a, c, g, or t
  misc_feature (5540)..(5540): n is a, c, g, or t
  misc_feature (5563)..(5568): n is a, c, g, or t
  misc_feature (5572)..(5573): n is a, c, g, or t
  misc_feature (5575)..(5575): n is a, c, g, or t
  misc_feature (5577)..(5577): n is a, c, g, or t
  misc_feature (5580)..(5581): n is a, c, g, or t
  misc_feature (5618)..(5618): n is a, c, g, or t
  misc_feature (5623)..(5624): n is a, c, g, or t
  misc_feature (5626)..(5626): n is a, c, g, or t
  misc_feature (5630)..(5630): n is a, c, g, or t
  misc_feature (5632)..(5632): n is a, c, g, or t
  misc_feature (5639)..(5639): n is a, c, g, or t
  misc_feature (5642)..(5642): n is a, c, g, or t
  misc_feature (5648)..(5649): n is a, c, g, or t
  misc_feature (5661)..(5661): n is a, c, g, or t
  misc_feature (5674)..(5675): n is a, c, g, or t
  misc_feature (5686)..(5686): n is a, c, g, or t
  misc_feature (5704)..(5705): n is a, c, g, or t
  misc_feature (5717)..(5717): n is a, c, g, or t
  misc_feature (5720)..(5721): n is a, c, g, or t
  misc_feature (5727)..(5728): n is a, c, g, or t
  misc_feature (5733)..(5735): n is a, c, g, or t
  misc_feature (5747)..(5748): n is a, c, g, or t
  misc_feature (5757)..(5759): n is a, c, g, or t
  misc_feature (5763)..(5763): n is a, c, g, or t
  misc_feature (5766)..(5766): n is a, c, g, or t
  misc_feature (5779)..(5779): n is a, c, g, or t
  misc_feature (5786)..(5786): n is a, c, g, or t
  misc_feature (5790)..(5790): n is a, c, g, or t
  misc_feature (5799)..(5799): n is a, c, g, or t
  misc_feature (5802)..(5802): n is a, c, g, or t
  misc_feature (5813)..(5813): n is a, c, g, or t
  misc_feature (5884)..(5884): n is a, c, g, or t
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcaaaaaaaaaaaaaaantccccnggggggggggggggggggggggnnnnnnaaanntntnttnntttttttttttttttttttttttttatttttatatantaatnnanaaananttacaanatncaccanncccaccccccancaaaaaaaaaaannaccaaatttcnattcacccaaaaataaannataaaacccccnaannttttcnnttttnnntttttttttttnnatattaaannnttanttncatttcaaaaaanctttatnttantttaaaaantanccccccaaaanatttaaaaataaaaaaacacccataacctcaaaaactaaaaccaaccacaaaataaattaccaaaccaaan

SEQ ID NO: 89678 - DNA, 5257 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcag

SEQ ID NO: 89679 - DNA, 5404 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagatatcacagggggatcctct

SEQ ID NO: 89680 - DNA, 2981 bp, Homo sapiens
  misc_feature (30)..(30): n is a, c, g, or t
agacagatacgaatcgagctggtacccccnactagcccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89681 - DNA, 5465 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcatttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89682 - DNA, 4722 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagacctgagcaagccaggcctggcttgctcaggtctacttctcccaaaactgcctgcttccagggacctgagctgaagctgaatgcctcctgaggaaagatgccattggcgaagtctcacctaccctc

SEQ ID NO: 89683 - DNA, 3042 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89684 - DNA, 1543 bp, Homo sapiens
  misc_feature (3)..(3): n is a, c, g, or t
gtngagacggcatggcccattcctgcacttggccagggtcccacactggtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89685 - DNA, 2452 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttcttctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89686 - DNA, 1489 bp, Homo sapiens
ctctgtgtaatcttatcactgcccattgttggcttttggtgttcttcttcttcactatcagacctgtgaaacttttttctgtccatatgccggtctgaatggaaggagtcattccgcatttctgtatcctctcccgttattctcccgtgcgcggtcatcatcgtagacttctggcttcggttggtgtctggacgcatctccagtttcgtgagtcactgccagcccccttctgaggccccccattctcggagtcacgtgactcggggttgggttagctcctcattttccgaatcactgcctgggttccttgggggatcttcactttccgagtcattgattcggggtatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89687 - DNA, 985 bp, Homo sapiens
  misc_feature (20)..(21): n is a, c, g, or t
gctgtgatctagcggatctnnccgactagcccgacagcctgactctaacttactataagatgagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89688 - DNA, 3317 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttaccccggggcgatgtggagcgcgggccgcggcggggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatg

SEQ ID NO: 89689 - DNA, 2652 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagcttttgatcacattttgaggctgcagggcgggttccca

SEQ ID NO: 89690 - DNA, 2003 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacggcacaaacatacgaagcagggacgaagaaaaaaaaaaaaagagagacaaaaaaagaagagaagaaagaagaagaaaagaaaatagagaaaaaaagaaaaatacaaaaagagagacagaagagaaaaaaaaaaaaaaaaaaaaaaaaaaaaaaaaaaaaaaaaggaaaaaaaaaaaaaaaaaaaagtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89691 - DNA, 1888 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacggcacaaacatacgaagcagggacgaagaaaaaaaaaaaaagagagacaaaaaaagaagagaagaaagaagaagaaaagaaaatagagaaaaaaagaaaaatacaaaaagagagacagaagagaaaaaaaaaaaaaaaaaaaaaaaaaaaaaaaaaaaaaaaaggaaaaaaaaaaaaaaaaaaaagtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagctcggccgcgaccacgctaa

SEQ ID NO: 89692 - DNA, 322 bp, Homo sapiens
ttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgcggtgagtttggtacttgggaaatctgcggtcggccagccaccttttgtagcacagaaggtctaaggaatttttaaaaaggaggggaaaggagagggaccgaactttttttttcctttctgttgctaacggag

SEQ ID NO: 89693 - DNA, 5460 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89694 - DNA, 5544 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcaaaaaaagtcgacgcggccggcaatt

SEQ ID NO: 89695 - DNA, 3856 bp, Homo sapiens
aatacggtgatgcttgtgacctgtgtctgttggggcttagttccttaagaatcctgattgaaacagtggcctgacacccagcagagatatgggtaatgtacacacaaggattcccaaatgaccaagaaggaaagctctgtaagggagtattaattgtttgcctccaggatcagtattcattcttggatcaaaccccagctccactgtacaccagccacgtgatgctgggtgcttcctcatcatctccacatgtccttttgccatctgcaaggggaggatagtaaccatgactcatctcacagggtgatgatgatgtgtacatgagatattgcaggtaaagatggagatgagaagcgtgaccagttattgtgactacaggatgaaggggctggtctaaccttgagcttgcgaggaaagcagagtaaagatgcctgctgaccctggacaagggttttctgctcagaattgtttgtccacttcaggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89696 - DNA, 2945 bp, Homo sapiens
actagccgaagcgcatacgtatctgcagtacacagaatagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89697 - DNA, 2810 bp, Homo sapiens
  misc_feature (20)..(21): n is a, c, g, or t
gctgtgatctagcggatctnnccgactagcccgacagcctgcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttccttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacatgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89698 - DNA, 781 bp, Homo sapiens
  misc_feature (32)..(32): n is a, c, g, or t
  misc_feature (55)..(55): n is a, c, g, or t
  misc_feature (67)..(67): n is a, c, g, or t
  misc_feature (101)..(101): n is a, c, g, or t
ttttttagcgcccactatacaaattctatgcncctcgcatgcaaaaatacggccncttggatcctanagagcggccgcctactactactatgctgcgagangacgacagaatgggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttca

SEQ ID NO: 89699 - DNA, 1925 bp, Homo sapiens
ccgggatccggttttttttgtttttaaaagtgtaatttcctttttatttgcatctgtttatgactgaaaaaaatgactagttattatgaagacactactgttgaagatggatattttaacatggagtttcaacaaaattacttcttgagacagagctgatgtgttttttaaataacgtgattttaagcatatatttgaacaaaactaaaacatttagtattatgaatatgaaaaaagatcagtaaatcaatgtactcttctaggctgaattaaggtagactatttaaggtttcaaaaaagtttggctggggcagaataagttttacaaaacccatgccatccaaaattaagatgacatgtagcagcaagaagtattccaatgtctcataaccagttctcgcaagcaatgtgtattccttactttaaggaagtgtcaaacaaatagaaaaatctggaagaatttactaagtgtaataaattagaggtaaatcgtaataaaagaatttatgtctcacaaaaatattcacaagtgggagttttcttttaccaacttctcagagtccttctagccccctcttcacttctgaaagatgggatttaccaaaatctggtttacatttaacttttcagggacacatgacctgaaaagaaagatgtcagataatactgacattgcctcatgcactttctttgtatcagtccttcttctgtaagtaatcagaattgggtccaaatggcatagaatcaaacattatgtatcatgccaaataccacttcctgcccaacaaaatttcatctttctccagtaatgaagaggtggacattcttgttggactgtagcatctgtgccgcccgctccacaccaaccacggcagctaacctctgggcatcatatttggagtagagaacagtgcaggtccacgtggcctcttctcctctgttggtggctctcagcatattacagatttcactgtaaaagtgtggatatgtcggcagttcatagaaaatcaggttcctgatgcttttattgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggggtaaattccttcctcgtgtacatggctttcaaagatcgcttccagctaacggattgccagatttatgaagcactgacaacgcctcactgacaacgacctcactgacaacgg

SEQ ID NO: 89700 - DNA, 396 bp, Homo sapiens
gatatttgtagattggatttattttaatggccctgcttactagcagaatgatgtgtgtgtgctggtggagtgggggccatggagtaataaacagctttagaaaatggctgggccgggtggggtggctcacacttgtaatcccagcactttgggaggccgaggcaggtggatcacctgaggtcaggagttcaagaccagcctggccaacatggcgaaaccccatctctactaaaaatacaaaaagttagccgggtgtggtggcgggtgcctgtaatcccagctacttgggaggctgaggcaggagaattgcttgaacctgggaggcagaggttgcagtgagccaagatcatgccagtgcactccagcctgggtgacagcgagactctgtctcaaaaa

SEQ ID NO: 89701 - DNA, 402 bp, Homo sapiens
cagcaagtaagtaagtggaacactcactatgccacacttgagttctgctagggttggaggggaatgaaggcaggagtgccagtctgaaagcatacactaagacaaaaataacatgatagtaaaatgatacttcctcattctactttaaatgtttttgccaaaagactatcatattagatggagtacaataggtgaagagaatgtgttaattgtacacacttttatatacctgtttaattatatgtatttttaaacaaaaagaatacatcaacacctctgattaaaatgaaagactgaaaacattttaaaatctcttcttttttacttccaaccctgtaaacattatgttagaggaacaaagaaaagtataaaaagccaacaaagacaaaaagaaaaatgaca

SEQ ID NO: 89702 - DNA, 803 bp, Homo sapiens
gaaaaggcaggagttttggggggcagggggcagcaataattctataacttccgggatgctgaggggcgttcatggggaggaccctggcctcctcctccccaaggcatcctcaccagtggtgtcaacaggaaaaatggcagcaaatacgctgcaggctgtggtctttctgcctttgaaagggtcagctgtacttaaagggactgtttcagctctgcctgggtgctgctctgggaccccctgctgccaacccaccactcccccaacaatcctctctttccatccatatcccccagtatggaccttccacaactcccagccataagctgaatgtttctctttaaaggatggagaaaacttctgtctgtctctggcaagaattgggggactgttgactgggattgtgggctgggcttggcttctaactgctgtgtgacccaagacagccacttctcctccctaaccttggttatgtcttggcagcacagtgagcaggtcggactaggcgaacagttttggattattgtgtttttagatgtggaattattttttgttatataaactcttatgtgtaaccccaatatagaaactagattaaaagggagtctctctggttgaaaggggagctgagtaccctctggaactggaggcacctctgaaaaaagcaaactgaaaaccagtgccctgggtcactgttactcctataagacagtttaaagtgagacctggaaaaacatttgctttaccttgaatagataggtttttatgttggtatataagaaataaaactaacctattaaacctga

SEQ ID NO: 89703 - DNA, 924 bp, Homo sapiens
gaaaaggcaggagttttggggggcagggggcagcaataattctataacttccgggatgctgaggggcgttcatggggaggaccctggcctcctcctccccaaggcatcctcaccagtggtgtcaacaggaaaaatggcagcaaatacgctgcaggctgtggtctttctgcctttgaaagggtcagctgtacttaaagggactgtttcagctctgcctgggtgctgctctgggaccccctgctgccaacccaccactcccccaacaatcctctctttccatccatatcccccagtatggaccttccacaactcccagccataagctgaatgtttctctttaaaggatggagaaaacttctgtctgtctctggcaagaattgggggactgttgactgggattgtgggctgggcttggcttctaactgctgtgtgacccaagacagccacttctcctccctaaccttggttatgtcttggcagcacagtgagcaggtcggactaggcgaacagttttggattattgtgtttttagatgtggaattattttttgttatataaactcttatgtgtaaccccaatatagaaactagattaaaagggagtctctctggttgaaaggggagctgagtaccctctggaactggaggcacctctgaaaaaagcaaactgaaaaccagtgccctgggtcactgttactcctataagacagtttaaagtgagacctggaaaaacatttgctttaccttgaatagataggtttttatgttggtatataagaaataaaactaacctattaaacctgaaaaaaaaaaaaaaaaaaaacctcgaggggggggcccgggtccccaattcgcccttatagggagtgcggattcacaattacggggccggggtttcaaaccttggggacgggaaaaacccggg

SEQ ID NO: 89704 - DNA, 367 bp, Homo sapiens
tagaggatccttactgcggagtgatgcttccccctctgtgaatgtggctttgggtatggctaatcaacaccctgcactctggccttcagaagcccagtgagagcagcccatgtgtgtctcacttgcctcaagctctctggcccctgtgctcccaaggtctccagcttggctccaggaaaaggcagggcctcatgtcaagtagtacttttcttaaggagcttagaggtctattgacatttgaagcagctccatccctaaaaatccacacactgaagcccttcttgggagggaggtgacagggttaatctaagggctgggggaggcggagaaaggccttgaaaccacacagtgaagccaaccagattaa

SEQ ID NO: 89705 - DNA, 636 bp, Homo sapiens
  misc_feature (634)..(634): n is a, c, g, or t
agccagaaagaaaaggaaatagaagcatttcatctactcctgtgcctgccagcatttctggagagaaagaaaggaacatgaaacaaatattttacattagctatgtttaccaatttgttttcaaaaaagaaagaaaagaaattatcttttactttaaacctttccaagaagacaaaacaaaattttctcacctgactaacccgtaagtctgccagtttcaaatgactttgaaataaaagccagtggaagaactgagtagctcagcttcccaaattacagatcctcggtgatggtatagattgccagtttagtggcagaatgacatcttttagtaaaggacaagaaaacgtcatcccacagagtcctgcacaaaatggactgttgacttgtaactaatgcaatagccaggattttactaactattcttcttggttacttttttttacagcaagacagggaaggagatgaaagtgatattaacaagaaggagatcttactataaacaaagatctgtaaagtaaaaaacaaactgtctaggctataagtgctataatatttgatataacgagagttgttaaatatggtctacataaaaaccatttattaagtacatagtataataccagaaaaaaanaa

SEQ ID NO: 89706 - DNA, 447 bp, Homo sapiens
aagagaacagagcgaattagtggcccagtcagtttccagggaataaactgtggtcaccagcaagctttcagagagaacttggtcatccgacaaggagcttccaatttggtttgagttgtggagaatttaacattgcccttgttccctagcaatcaggaagcagaggggaaagatcagttttaaatgtgtctcatctctattgtcaccttttgctgtctttggacctcctttgcgttgaggtccaaaaggaagttggaaaattatagtgaaatatcttcacatttgccctgttgaccttgcaacttaaaggaagtttaggcacaaaaactccagagacagtcccaactgaaaaagttcacaaagagcaaagactgggccaattctggatgcatgcctatgagttagccctctctgcaaggaaaatttattttttctaaataaaatttt

SEQ ID NO: 89707 - DNA, 523 bp, Homo sapiens
aggacttaaaactggtttgaaagcactgagctaccaggggatcttccttcgcccttcactgtgagaacctgctgaggtccctgaaaatacagtccgtgaaagtgcaggggccacctgagactgtgattcccaggagtttctcattcaagtccatactcagcctccaacaaaatttatcaaatttactgtgtaaaggttctgtctactttatggcttgagtaccttctgcttcagcttacagaaatgatgccatagaaaaacaagcacattcaagatatgggacatgctgtgtgtctaccattctagacttctccaaattgcagtgccataaatgaggatggggatattctaaattttgaaacaaggactaaagagacataaccaaatgcaacgggtaaaccttgactggatcttgaattaaaaagtcattttaaagacaactggtgaaattttaaatttaagtattagctgatactatggaattattgctaatgtacatgtggttatataggatagtgtcctt

SEQ ID NO: 89708 - DNA, 1530 bp, Homo sapiens
cgcctaggaagtggggccggcagagggggcggggaggagctgtcggggactgggaggagccgcaccgcggcgggtggacaaagcccgcggtcgggtgaggcgggacggagttggggccggtggggaggggcatgaggcgctcgcaggcacctcgagaagcaggccccgaccgctcgccgacgaagcctcgtccgggcctcctgggagcggggtggcaggtaccgtggcgcctcctcgcgttggtcttgctggttctcggcccccgaagcggagcgacggagacacagctgtggaagcatctggatccgctgcccaggtccccgagcttcccggaacccgaggccgcaggacactgaaggctgccattcccgagtaggtcacgctggacgccaccctaagctgggcccagaggctcccgtccaggagggctgcagtcggcgcagacaccgcgcgtgtggagacgggagacccatcctcctcggccgttccgagagtaggcgcggccggtcagattcgatgcagagccgaatgcgggagaaagggcaaaacgtacctcaaaccagacaaagccttgtgagcttcaggttctcaaataccccactcacccagaccccacatctccagtcagcccctcgcacccaaatcccattcggagcaaccgaactgcacgtgggactagttcttgggaatggatcaagccagtctcttcatctaacggagacagccctgggtggctctgtcacacagccactgtcttgtgcacaagttctgaacttggcctcagagaagccccagagtagaaagaagacaaaataagccccagttcttcgattctgggctgaagtgagattttcttgaatggcagccattgttttgcctcttaggtaagtgagtgcagtaaagaccggtaaggcccacgcagaagaaacactgaggaaagaagacacttccaaagtaacaaatgggaggaagcagccaacgcccgaggacaacatggcaagaaggagcctttggattccggactgggatggaaagagagttgattgaatcccggaatttggaaaccccagatacggagggcggacggtacaaccggagctgtcaggtggatttccaaggctttgcattggctgtacctgaaacttatggtggcctagactccccagtatccactcttccttatcttggtaaacaagcccagttctgagtcacatccctgctctgcctacttacaggggcatgtggtcccaatctaagcaacgtagcataattccaacctaaatcagcagaatcccattccctgccacagttattggctggcaatgagcgtaacatatttgggccaatgagaggagcaatttcctggtctttgttgggaaaagtttttctttcattttctgagagcgcttcagaggtaacccattctttctgcatgtcctcaaaaaaacgggtcccctggatggtgggtagccatcttccaaatacaagtctagccgggttaaaataaagaagacatcaagaaaacaaaca

SEQ ID NO: 89709 - DNA, 1222 bp, Homo sapiens
cgcctaggaagtggggccggcagagggggcggggaggagctgtcggggactgggaggagccgcaccgcggcgggtggacaaagcccgcggtcgggtgaggcgggacggagttggggccggtggggaggggcatgaggcgctcgcaggcacctcgagaagcaggccccgaccgctcgccgacgaagcctcgtccgggcctcctgggagcggggtggcaggtaccgtggcgcctcctcgcgttggtcttgctggttctcggcccccgaagcggagcgacggagacacagctgtggaagcatctggatccgctgcccaggtccccgagcttcccggaacccgaggccgcaggacactgaaggctgccattcccgagtaggtcacgctggacgccaccctaagctgggcccagaggctcccgtccaggagggctgcagtcggcgcagacaccgcgcgtgtggagacgggagacccatcctcctcggccgttccgagagtaggcgcggccggtcagattcgatgcagagccgaatgcgggagaaagggcaaaacgtacctcaaaccagacaaagccttgtgagcttcaggttctcaaataccccactcacccagaccccacatctccagtcagcccctcgcacccaaatcccattcggagcaaccgaactgcacgtgggactagttcttgggaatggatcaagccagtctcttcatctaacggagacagccctgggtggctctgtcacacagccactgtcttgtgcacaagttctgaacttggcctcagagaagccccagagtagaaagaagacaaaataagccccagttcttcgattctgggctgaagtgagattttcttgaatggcagccattgttttgcctcttaggtaagtgagtgcagtaaagaccggtaaggcccacgcagaagaaacactgaggaaagaagacacttccaaagtaacaaatgggaggaagcagccaacgcccgaggacaacatggcaagaaggagcctttggattccggactgggatggaaagagaggtagattcagctaccatatgccattactgtagttagtacagttgtctctatatccgtgggattggttcccagactctggattttctaagatgttcaagtctcttacataaaaatggtgtatttccccatatactttaaatcatatctagattacttataaaacctaatacaatgcaaatgcta

SEQ ID NO: 89710 - DNA, 639 bp, Homo sapiens
cgggtggatcatgaggtcaggagattaagaccatcctggcctgcatggcgaaaccctgtctctactgaagataaaagaatgacctgggcatggtggtgggcgcctgtagtcccagctgctcggggcgctgaggcaggagaatcgctcgggcccgggaggtggaggttgcagtgagccgagattgcacggcggacggtacaaccggagctgtcaggtggatttccaaggctttgcattggctgtacctgaaacttatggtggcctagactccccagtatccactcttccttatcttggtaaacaagcccagttctgagtcacatccctgctctgcctacttacaggggcatgtggtcccaatctaagcaacgtagcataattccaacctaaatcagcagaatcccattccctgccacagttattggctggcaatgagcgtaacatatttgggccaatgagaggagcaatttcctggtctttgttgggaaaagtttttctttcattttctgagagcgcttcagaggtaacccattctttctgcatgtcctcaaaaaaacgggtcccctggatggtgggtagccatcttccaaatacaagtctagccgggttaaaataaagaagacatcaagaaaacaaaca

SEQ ID NO: 89711 - DNA, 1276 bp, Homo sapiens
cgcctaggaagtggggccggcagagggggcggggaggagctgtcggggactgggaggagccgcaccgcggcgggtggacaaagcccgcggtcgggtgaggcgggacggagttggggccggtggggaggggcatgaggcgctcgcaggcacctcgagaagcaggccccgaccgctcgccgacgaagcctcgtccgggcctcctgggagcggggtggcaggtaccgtggcgcctcctcgcgttggtcttgctggttctcggcccccgaagcggagcgacggagacacagctgtggaagcatctggatccgctgcccaggtccccgagcttcccggaacccgaggccgcaggacactgaaggctgccattcccgagtaggtcacgctggacgccaccctaagctgggcccagaggctcccgtccaggagggctgcagtcggcgcagacaccgcgcgtgtggagacgggagacccatcctcctcggccgttccgagagtaggcgcggccggtcagattcgatgcagagccgaatgcgggagaaagggcaaaacgtacctcaaaccagacaaagccttgtgagcttcaggttctcaaataccccactcacccagaccccacatctccagtcagcccctcgcacccaaatcccattcggagcaaccgaactgcacgtgggactagttcttgggaatggatcaagccagtctcttcatctaacggagacagccctgggtggctctgtcacacagccactgtcttgtgcacaagttctgaacttggcctcagagaagccccagagtagaaagaagacaaaataagccccagttcttcgattctgggctgaagtgagattttcttgaatggcagccattgttttgcctcttaggtaagtgagtgcagtaaagaccggtaaggcccacgcagaagaaacactgaggaaagaagacacttccaaagtaacaaatgggaggaagcagccaacgcccgaggacaacatggcaagaaggagcctttggattccggactgggatggaaagagagttgattgaatcccggaatttggaaaccccagatacggagggcggacggtacaaccggagctgtcaggtggatttccaaggctttgcattggctgtacctgaaacttatggtggcctagactccccagtatccactcttccttatcttgaatcttgctctgtcacccaggctggagtgcaatggtgcaatctcaagctcactgcaacctctgtgcaggttcaagtggagaatctgaat

SEQ ID NO: 89712 - DNA, 289 bp, Homo sapiens
gcacacgtgtgtgtgtgtgtgtgtgtgtgtgtgtgtgtgtgtgtgtaaggtatcactctccactttcagtggctcccacagcacctagaataacatccaagctccttggcatgactttcttggcctgaaatggccctgccttgtccatctctcccacttcttggatggcttcacacactcctggactctatattccggccacctggcctcttttctgttcctcacatgccaatctctttcctgactcttggcctttgcaccagctcatccctttgcccagaaggttctt

SEQ ID NO: 89713 - DNA, 493 bp, Homo sapiens
taacgaatgaggcaatttattaacccagcatggtttgttctaatgcttcttgttggcaactgccacctgtccggcgattctgtccagatctctttgtccctgacgtgtcagtttgcggcccccatcttggtccttttccaccatttttagcccctccagggcttggaggacccggtgggccacattcttggagcctcggctaaagtggccaggcatgccgccacttctctgacatcccccatagatcttggtcatggagccaaccccagcgccaccccagaggtacaggtgccacgctgtggaagcagctcgcgtgtacaaccagttctcatcgtagggagcaagctctttgtgcttggccagcagcttgacggtgtccacccattcggggactttcagcttcccagactttctgaggaaggctgccagagctctgatgaactcctgctggttcacatcttttacagtaactccagcatcatgcggcccggcc

SEQ ID NO: 89714 - DNA, 546 bp, Homo sapiens
ttgtttttgtatttatcgtagagatggggtttcaccatgttagccaggatggtctcaatctcctgacctcgtgatctgcccgcctcggcctcccaaagtgctgggattacaggcatgagtcaccgcgccaagccaaatctttgtaattatacccattggggtgtttttccttaacctacctactagcttacaagcttttgaatagttgggatttactcatcttttgggagagggccttctgttgtccttaattccaggccttacataagcttggggctccataaataggtgtgaaattgagcaggtattttatagcatgtggacaattcatatctctgggggcttgttaatggtgaagggcctgttgccagggcctgtaaggggcagagagatgacaaagagttggtggggtggggtcgaaaatttatttggcaattactgaatatctagaaagtgcccagttggggctgcagcagttacaagcatagacctcttactaacctattgaccctgagcaagtggtcttcctgaggctcagtttcctca

SEQ ID NO: 89715 - DNA, 1753 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 89716 - DNA, 1440 bp, Homo sapiens
tgtacacaggcagtttgttgggagcgttaccattgcctctggttcctcatgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 89717 - DNA, 2344 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagcattcacagggtcagtgtggatgttttctcccaagttatgaacacggctataggggtccccaaacaaccccacaatccaggccttggaatgagatcgctgtggtcaggccttgccctgttttgagaaagcccttggtgggaggactcctgcaaggctaaggggggcgggggtgctccggcgagcctcctccttagtctttgcctgggacatttctttccccctcctggtgacaagtcactctggaaacctagttcctgcagaagggaggaattcacaccctggctggtctctgctgactataattagaacccaagggctctcacccatctgaaaaagaagtcttgagaaatagaggggggtcagaagaagaaacttgaaggtaagcaaatactgttggaacattccatggcaaagccaccaagttacctagaggtctctgagcctgtgcctttccttgtggtctagaatcttttacacagtgcttatttgcagcctcttcttatgactactaggtcactttttaaatctcagtttaatgtattcattcagccatttatgttaagtgcctaatacatgccagacattgtgctat

SEQ ID NO: 89718 - DNA, 1236 bp, Homo sapiens
tcccagtgctctggctttgcttctctctagctccatccagcttatgaaggtgttgagactgctgagatgaaatcaggaaagcaactaggatcttatgagatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 89719 - DNA, 2275 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagcattcacagggtcagtgtggatgttttctcccaagttatgaacacggctataggggtccccaaacaaccccacaatccaggccttggaatgagatcgctgtggtcaggccttgccctgttttgagaaagcccttggtgggaggactcctgcaaggctaaggggggcgggggtgctccggcgagcctcctccttagtctttgcctgggacatttctttccccctcctggtgacaagtcactctggaaacctagttcctgcagaagggaggaattcacaccctggctggtctctgctgactataattagaacccaagggctctcacccatctgaaaaagaagtcttgagaaatagaggggggtcagaagaagaaacttgaaggtaagcaaatactgttggaacattccatggcaaagccaccaagttacctagaggtctctgagcctgtgcctttccttgtggtctagaatcttttacacagtgcttatttgcagcctcttcttatgactactaggtcactttttaaatctcagtttaatgtattcattcagccatttatgttaagtgcctaatacatgccagacattgtgctat

SEQ ID NO: 89720 - DNA, 1706 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggtaaggactctctggccacccagtgcgtggccacgtttggctggctggctgggcaaatgcgctcatggaatgcctggtgccagcctttggagctgtcagttcagctccctggcatccttcagcgtgcatttccaaaatcagaacacagtgaattcaatttgagattatcattcttaccacaaacttcattgctctataaaggaaaacaagagttaaacccaccaaaagaaatcattgatttcagaaatggaatctcacatcacacgcagatctcctcatgttggtctcctattctaatggctggtccctgataacctacaggatgcctgacttaacaacgctgtcccagacctgcaggacatctaggtcctctccagctatgtctatgtctgtgtctgtgtactcatacacagtgcatacttgcacactataccataaatggtctccc

SEQ ID NO: 89721 - DNA, 1180 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggagctagctccactgtgagtgtagtccacatctgggcacaacacttcccaaatgccaagctagcgctgctgcgagtgtagtccacatctgggcacaacaggcccacgtttgaattagcataaaataaaaatattttatata

SEQ ID NO: 89722 - DNA, 934 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggtgagtgcgggggcgggggcgcgccggccgaggcagcctgggcacgcgtgctctccctacgcgccgctactcgtgggctgcggtctctccaggaacagccctctcggcgtcccggaaggggtctgctgccgggaggtgggacggaaggtacggtgcagttagtgtgttgcgtgtggggtgtgcgggatacatcgagcgcctctggtctttctctgggggctgtgagcgtgtgtgccgcgcgggatgtcgcgctcacacccgggcaggaccgcccgctctcacctgcccctcaggtgaccgcagcgtctcttcctccaagcccatgtcgtgcttcgcagctcctagtgccggaaagggaaaagaaccggtgatcaatgaacttgcgggtgaggtcttcttgatgtgtctcggctcaaggggcgcttacctgctaacgtttgggaagcaagaaaaagggtgctttgctggtttcgtcccctatcaccggatttccagatagaaaagagaacatgaaagaaagtaatgctgtggagtcacctactaggacatgtttaggaaaaa

SEQ ID NO: 89723 - DNA, 1793 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgagatggttcctacctggctgagttcctgctggagaaaggctagtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 89724 - DNA, 1684 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 89725 - DNA, 2017 bp, Homo sapiens
tgacgcgaatgacgctgcgccagtcaggccgcagccccgctgcttggcccgtcgggcccgccttggccggctcggcccgcccccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgacgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggagaccaattaattgttcaaaggtaatatatagagatctcaagagcatttactttggcacagtctctgcccctttgtggtctggctaacaataaagctaagatttgttttgtaatgacggttccagttggactggaattcctttgaagttcctgaagtttgctgttgtgagagctcaagatattatttgactgcaatgaaacactctctgtgtattatcaaaatatcgtatacactgaactgtaacaacttgcagtaatcagacttctccttcgaggtggcctgcgtgagtagagagcatccacagagagatgagcttctcccaacatccatttagtgttcagtcatcacgggccactcatggatctgaaccttcttacaaggtcgataccaacaggtatgaggagcagagagcagatcagcacggagcagcattagctggggcccccttgcctggcctggcagtgaagatagagcaccatgccagttgttcagcttctcagcgcttgcgtcagctgacctaaattatttaaggatgttgtcacctctaaataaatatagtcattgtcctggtctctatttatattttaaaactctttcccagcccaccccgatggcctaaaacaattcatatatttcagtagaagagggtgtcacagggctatttgcacaggtttggatccagtgccagcgttagccttcacacaagttacactcctctgagatgtaactgtctcctgtgtatgagtgccaaagtatt

SEQ ID NO: 89726 - DNA, 369 bp, Homo sapiens
gcttaacatgctgtgaacagacagtgtctggagaggatgacaggagtgggagaggaagatgccgctgcagagacttctagcaacgaactccgacactgacatccctgggcaaatcactgccacttgtttgaaaaacagcctcaagtggatgtcatgctgacgatgctgagatgacttgagccaaatgaaattgcatgtatgactgttcatttctcctcactccactcacggtaggtgccagagacagagggcctcaagccagggaaggaggatgtgacattgctttcctcttcgtagaggcgatgtcacccttgggcacttgctcctagagagctgcatgcagctggcaactgcaccagcacagcaata

SEQ ID NO: 89727 - DNA, 116 bp, Homo sapiens
cagcaacaacatgaacttctacacagcctgatctagcgatgagcccaaatcgattcagcaactccaaaggacttaggattgatgtcattggctatctaacccccaggaatatgagt

SEQ ID NO: 89728 - DNA, 393 bp, Homo sapiens
ggatgagatttgctttctccgttaaggtgatgcgtaaagctttctttggagggagagaaaaccctagagtttcctgaccttccttaacctgagctgcttggttccctagaagcagaaattgatcatattagaacccaaactcataccaactttgaccttcatgaagtactcaagtgtttctgctcttcttcctcatgtgatgtagaaagtattaaaagtgatgagtttaggccaggcactaactggttcacgcctgtaatctcagcactttcagaggccgaggtgggtgcatcacctgtggtcaggagttccagaccagcctgggcaacatggtgaaactctctctctactaaaaatacaaaaactagctgtgtgtggtggtctgtgcctgta

SEQ ID NO: 89729 - DNA, 855 bp, Homo sapiens
taaaataataataacatgccatataagttctgggcaacaggcagataatgcaaatcctcagaatcttataccactaaaaggttttttagtgaaagtttgtttttcagtccagttcaagaaaaacacaaagagagcacactgagttcccatgtcccctgcatcatttctcctgttattaacatcttacagcagtgtattatattcattaccattagtaatagtaatagtagctgaagtccatacattattcagatatccttagtttttatctgatgtcctttttgtattccaggattccacccacaataccacattgcatttggtcattgatttctattccaggtggtctggattcagtctttactggtagtatgcgtctgtgtgtaaaagtagttactctttctaagggtctctattgacgatgctagtaaagcattcatagcttcataccggcgtagtaatattaacctccatcccagagcttagctgtatagccactttatctaagcaaaacataggcaacacctagcgtggaaattaaaaaataaatagcccacagcagccacagcaagtgacagcacatagctgctaacattacttctctaattcatactttattaaagaagggaagactagggaaggggaggacttgaggatggaagccaaacaaacatccaggcttggatgttacatttgagatttctgtgagacatgagaatgcagatagttggaaccatgcatctcgctgcagaaagagggaggagccaggagactgggtaagagttcatcacccagagagtgagaacaggtgttggagcaaagaccagcagactgacctccaggtttggacattaa

SEQ ID NO: 89730 - DNA, 482 bp, Homo sapiens
tttggtaaggggtttttcccctaacaatcacagccgtgccctctgcaccttccatgaaaccctgaaaagactggaaagaatgcgtcacctccgtgacagcttcttcacccccgcctgttgctggtcttggtgcttgtctacagagatttagtgtcatggcaagaaattaggctttgggcctaaaagggtttgattcagatatggcctccccacatccttggtatgtgaacctaatatcacgaagaccctctcctgtgtggtggcttgggagtggaatctgggtttgaagcccagctctgccagtcactggcaatgtggccttggatcagttatctacaggtttttgaacctcagtttcctgatctataggattggggcaataatatctaacttattttggggatagtaagttacattataaaatgcctcatcttccacaatgcatgagaacaccagccaaatcatagcccctgtgtagaata

SEQ ID NO: 89731 - DNA, 244 bp, Homo sapiens
aaactttgcaattaacctttacagaaaccagaggaagccgctcatgacacccgggagctcacagaggctctgaagtttctattcaagaaaacaactccagatggggctgatctggaagacaagtaacatcttccttttcttggtgctcgcctgccgtgctctaggtgcttttagagatgctggtctgtgtgctagggaagcgatgaaccatactgttagtctattaaacataactcaacctggc

SEQ ID NO: 89732 - DNA, 951 bp, Homo sapiens
gcgaaaccctgtctctaccaaaaatacaaaaattagccaggcgtggtggcgggcacctgtaatctcagctactcgagaggctgaggcaggagaatctcttgaacctgggaggtggagattgcagtgagccgaggtcgtgccattgcactccagcctggacatcaaagtgagaatcaggccaaaaaaaaaaaaaaaaaaaaaaccttgacgtgtcaatgtttgtgtctggcctaggagaatgaggatgacagcttcacttgccttttgaagaagaaacattacaaaaccttaacctgaagtataaagtcaaaagatacggctctttctcacacttgcaagacttacaaatacagcctcaaacattatgacacaccaacaatatctagaaagtaagaactggtgtagcaatgatgcttcatattctagctgtagccacagagttgagggtagtttttgtaggtctaaaataataatctataaagatgtccaaagttaaattttcaacaatacaaatctagagaagtgacagcctacattacttcattattactcttcttttagtctttagtctttaatattttaaagtttactctataaatcagcattttgtaatcctttataaactcatccagatttaaatgctactttttcatgaagaaaggatgataactttatagacagtcagtgcaacacacacattttatctcatcaccgtcttaactgcccctcccatccactgtctcataaagccctcagctgaactaagataaataatacaatggaaattattttcagttccccttgcactgtcaaagtaaaacaagaaaactgaaaagctgcacccccagcaagaaagggaagtatgctgttgtatgcatcattactcaacaattaccctctaactaaacatcctgtttaagagtttaattcaaacaacagccagactgttaa

SEQ ID NO: 89733 - DNA, 455 bp, Homo sapiens
acgctaaggtgcaggacagtatggcagcagtgagctatgatcatgccaccacactccagcctgggtgacagatcaaaactctgtctctaactcaatcaatcgaaagctagaaatgattaagcttagtgaggaaagcacatcaaaagctgatatggggccgggcgtggtggcacatgtcctgttatcccagctacttgggaggctgaggcaggagaatcacttgaatcctggagggcggaggttgcagtgagccgagatcaagccactgcactccagcctgggtgacagactgagatcctgtgtgaaaaaaacaaagttttacatttaatttgatactcatgatcattcgatggggtgagtactattatttattcccgtttcacagataaggaaactgaggcttaggcaggttgggtggcatgcccagggccccgtacagtgggagctggagttca

SEQ ID NO: 89734 - DNA, 146 bp, Homo sapiens
tttaaaggagtgctgtttttcctttcttgcctaatctagccccctcctgagtccctgtgaacctctggtatcaactcagtttgggcccagtagaaaggagtggcctagaatagaaaaatctcctatccatcttttacaatttgtct

SEQ ID NO: 89735 - DNA, 318 bp, Homo sapiens
  misc_feature (127)..(127): n is a, c, g, or t
  misc_feature (178)..(178): n is a, c, g, or t
  misc_feature (267)..(268): n is a, c, g, or t
gagacagagtcttgctctgtcaccaggctggagtgcaatggtgcaatctcggctcactgcaacctccgcttcccgggttcaagtgattctcctgcctcagcctcccaagtagctgggactacaggcncacatcaccatgcccacctaatttatgtatttttagtagaaatgaggtttnaccatgttggccaggccaggcacagtagctcatgcctttaatccagcactttgggaggccaaggcgggcagatcacgaagtcaaaaaannctttaccacctgtacaaaaccctgtccaaagtaagaaataattaaatctt

SEQ ID NO: 89736 - DNA, 385 bp, Homo sapiens
attcaattttgttagataattttcaactattttccaaagtagttctaccaatatatactattatcatcaattgatgagaattctacttgctccacatcctcattaacacttgttaacgtcagaccttttaatatttgcaaatctgatgggtatatagtggtatttcatttggttttaattttctttaccctgattaccaaaaggttgtagctttttatttgtttgttttttagccacttggatatcctcctttgtgaagtgccttttcaataatttgtccaccttcctattgggtcacctgtcttttcttaacaatttaaaggtattttctatgtatctggatcttatttgtctttatgccctataaatatattttcccattctg

SEQ ID NO: 89737 - DNA, 306 bp, Homo sapiens
ggatgttgggtgtgctgagtgatagtgttacttgatgccgtacaggtggctgctctccctgccctcctggccccaacagcagcctggtagcacagggagggtcccaggccaggccccctcaggggcagtctgaggcagttcctgcagggactccgctccattttctcctggacctagtgcctgagagccaggccctggcctctggccttctcctcccaagtcccagccagggtcctctcaggctgggcacagtggggagggagggagtctgagtgtgcttttccctggggagttgaattcagcctc

SEQ ID NO: 89738 - DNA, 450 bp, Homo sapiens
ccgctgtctgcagtagatgcccttgcttctggcctcctgttactcttgtttctttctttatcttttcttgaaaagattctaaaatgtccccgcctgtcagtgcccggatctcccgcaggcctggtccaagtggaggggaattccgctgctgggaccttctgctcccggggctgtttcccgtcctgctctgcgctggcgcaggctgcgaggagctctgaagccagtgggggccgtgcccggcctccctgctccccacctttagggagaccccctctcagaacacatggtgctgtggaccacccctcagtcccctgggtagcatccagggactttctggggtctctcatttctgtcccagaaagcacgaccccgggattagagaagatcgccctccacgctccagagactttggaccacatgatgccaagtttatggacagacccctgagtc

SEQ ID NO: 89739 - DNA, 374 bp, Homo sapiens
atttctaactatcatttaccaggggcactatgccactttcatttcctttgcttcattctctttaatgattattaccatgttcaagttctctaaaaagtaatatatcctggtggtgtatttttaataatagtctgcagatatttccagtggtaacttttccaattttatattttattattctgtaatggaagtaaggccattagtgtttattataattttgtataatgctttaatgtatcttaaataatttcccccaagtaattttaattatttgagtgtatgtgaaattggctggaatgggaattgtatctaggcattcttagaactcataacagtgctagaagtagacataatttatgtttgcaaaaaaggaa

SEQ ID NO: 89740 - DNA, 164 bp, Homo sapiens
gattaagtgctctccgtttagcctggcattcatggatttttatagtcaggacccaactaattctccatagctcttctccgaacaatcacgtcagccacaccggtctacttgtcacctctgaacaggctttcctctgtttggtgaatgctattctggtgctgttc

SEQ ID NO: 89741 - DNA, 275 bp, Homo sapiens
ttcacatggaatccaggaaacactgtcgacagagaccaagaaaagctaaattccccaagtaaatggggaaggctgtggctatggattttgggagtttctatgtttaaacaaattacccaccccccaatctgtagatgcagtaaatcttaagcaaaatcccaacagggtttttaaaatgaacttgacaagcactgtcattttatatggaaggcagaggggcaggaacacatcaagtatcttggaaaagaacatggattgccaggcacagtggctca

SEQ ID NO: 89742 - DNA, 750 bp, Homo sapiens
aggcatgcaccaccacacccagctgattttgtatttttagtagagacgggttttctccatgttggtcaggctggtcttgaaatcctgacctcaggtgatctgcccacctcggcctcccagagtgctgggattacaagtgtgagccattgcacctggccccctggctaatttttaattttttatagagttggagtctcactgtgttgcctgggctggtctcaaactcctggttccaagtgatcctctcaccttggcctcccaaagtgctgggattacaggcacgagccacctcacccaaccttgaatagttttgtcatacaatttgaaattgggaagagtgaatcctccaactttgttctttttcagtattgttttggctcttctggatttcttgcatttctatgtgaattttaggatcagcttattgattctgcaaaaaaccagctgggatttttataggaattgtgttggttcttcacatcaatttgggtagtattaccaccttaacaatattaagttgtctgatacaaaaacatttaatgtttttccatttatttggtcttacttaatttctattaacaatgttttgtactttttagtgtacaaatcctcctattctttgttaaatttcttcctgtgtattattctttttgatgctattgtaagtagaattgtttcttttaattttatattcagattgtttatttctaatatatagaaatatacttgatttttgtatatcaattgtgt

SEQ ID NO: 89743 - DNA, 440 bp, Homo sapiens
gcctagttccggtggggggatatgtgtaggtctatttctggacttgatactttctttgtactcctaaggacgtactcatacgaggagaatatcagatccagaaatagacctgcacatatctagtcaagtggtttttgacagaggtgccaaggtaattcaatgggggaaaggaaagtctcctcaacaaatggtgctggatcacccaggttgccatatggacaaaaaggggcatcaacccttattcaagagctaactcaaaatggatcataagcctcaatgtaaaacctgaaactatacaacttctagaagaaaacaaaagagaaaattgttgcaatcttggggatagccaaaattttcttagacatggcaccaaaaggctgggcgcagtgggcttcacgcctgttaatcccagcactttcgggaggccgaggcgggcagat

SEQ ID NO: 89744 - DNA, 317 bp, Homo sapiens
agggtaaattgtgagactgtttgtatatattttttgtttatatgtttttgttgttgttatgttgttatttttatttataaaatgatagatctgtgggtaggttctgagaaatgaatagcttgtatttccttttttatgaaagaagaagaaaatgaagttcaagtggaaagtatctccagaaagtttaacattttcttattaaccaactcattgattggcatgtgaaacttgagatattttatatagcactttttaaatgaggatctagcttcacttatcatacaacacattaaatagcaggtcatgtcatataggga

SEQ ID NO: 89745 - DNA, 344 bp, Homo sapiens
aaacaccgcaatctagtaattaaaaaaaaattttgagtaaagtatgaaattttgttaaggggctgcatgtatagttttgatatgaatgaagctatgtttcagatggttaatttactttggttgtttggaatttccaatggttttttattttacagagtcctgccaaatttataacaactgtagggcagggtgtggatagggatatttttactgagtaaatactattacatgtactagaggtattctgttatgttaaaatatcccgttagagatacatgatgaaacacatatggatgaaatattatggagtatgagatattgcaaaataacatggaaagatgggg

SEQ ID NO: 89746 - DNA, 540 bp, Homo sapiens
aatagagcactgggttccattcccagggccatctagctggtggccatgtgtccgtcatttcacagggtggggttacatggtgtggcagggcaaagttttgggagtccatttggaaactatcagtctctcctaggcttattttctgttgtgtaaggaatgaatgtgttgtaaggattgaatgatgacatgacatgctttttaaaatttctagctcagtctctttaatgtaaaaatatgtaatcatccagctcatagttctgagggaaaccctatatcacatatattttacactgaaggaagacattaaaattccattctcttcacacagaaccaaccaaccaggatggctggcctgttggggaagcaggttctgccatctggttctcagcaggcatgtctggaagcaggagggagcgtctctcccatttgggtaccaaagcctctgtaacagtcaggaatgttctgctgtggcctttatcctaaacttggcttggccagtgtgtgtctggggcaggagcagaggccgggacacagctgagc

SEQ ID NO: 89747 - DNA, 541 bp, Homo sapiens
atagtttctccacaggcataagaggcaaagcattgtttcagaagtggactggcacctcacctgagatactcaagactggcaacatgggtctacattctttgttaccacagattcccttgtgtccggagagattccctagctctaatgacagattttttggggggtaatgaggctatgagaagattgaggatctaggtacttgcctttaactctacagcatacaaggtgtgtggctcttatctctaggacaccaatatttaatgttgcatatcatgtatctccagtacaagaagaaagtttatcagaatttagttaatgttggaaactttgtaatataaacaatgtaaacactacattgacaaaaatattttattaatacaaagaatatgcatatagtttgcttactacagaaattcttgtttttgatgtagacaacccaaaggagtttttatgtatatagattgtgaataaattgggaaaagaaatagagataagtagagattatttcacttcattaaacttttgaagtcctaaattagtt

SEQ ID NO: 89748 - DNA, 333 bp, Homo sapiens
gagagagagagagagagagagagagagagagagagagagagagagagagagcagattgctaagcaatcttcatatgcagtgtgctacttaatccttatcacaattcaattaggaccttcaatctgagttcttttccagacttcattcactgcagttgtaggaaaaattcttcccttcaccttgaaaatattaactcagtcacttcatcttatagaaagaatacagcattgtctaatgactagaaaggtcagggaaacagaacaattttcaaagagaaagaaggattcagacatcaaaatatttattcaatggtgagaaaaaaaaatttgctat

SEQ ID NO: 89749 - DNA, 438 bp, Homo sapiens
actgcagttaggttaaaaataaaacaatatgattaaaattagaaatgcaaaataggaaagatttgtactaaaataagctgtttgtactaaaataagccattgctctaaaatacaaataatatttaattctatattatgatactcaaaagaaatgaggccaaagcttttttcctgcagaatgtgggacttgaaataattaatgatagttgaaaatgttatttcaagaactaaggtattattataaaatttaattgagattagagcttgatggattaatttgatttatttctatggcactttgtaattgtataaattatgcattctcttttccatgttccttaaaataatagcatctttcagttaaaaatttggcctgacaattcagagatacggagtctaatccaagatccacccctgattatgtgcccctgaggaatc

SEQ ID NO: 89750 - DNA, 172 bp, Homo sapiens
tgttgcgacccctgagatgtcaactcctgcctttctgttgtgtttgcagaatcttggctgggaggtagagggggtgacagaggaggcagagagcccaggtagcctcagtcctggaacttggcactctctgattgtctcagcctccctgtctgaccacctgtctctcacaaag

SEQ ID NO: 89751 - DNA, 377 bp, Homo sapiens
gttaaaagttgaaacagaaaacatggaagtatgcttttaattgatcattgttatatatagagagtgaattaaaaaatttatgcatataaagttactaataattttttgagcacatatagtttcctacatacttacctatatctattctttaatccttgtaacagccccatgaactatctactattattatcatcattccatcttgcaggtgaggaagctgaggtctagagaagttcattaatttgactaaaggcacacagtcaataaatggtagagccaaggtttgaaccctggcattctggttttatgcttttaaccagctgcttattattggtatcttattgtgatgattttggaaaacactactaatttatttg

SEQ ID NO: 89752 - DNA, 256 bp, Homo sapiens
aaaagaaacaataaataattttaagagagaactagttgggtttcaggggagctaccactgaagccttaaaggtctgaaggtggtgtttgtaggtggagaaagagggcattccatgcagaacaggaagaggcagagtctcagaacagaaatatggattgtttagggaatggtaagtaattgtagctttgtataaaatgtatgtgtgaaggccagctttaaatgataatggtatgtaaatgtggttgggcaaagtgag

SEQ ID NO: 89753 - DNA, 396 bp, Homo sapiens
acctcccgggttcaagcaattctcctgcctcagcctcctgagtagctgggatcacaggtgcctgccaccatgcccggctaattttttatatttttagtagagatggggtttcaccatgttggccaggctggtctcaaactcctgacctcaggtgatctgcctgcctcggcctcccaaagtgctgggattacaggcgtgagccactgcacccggccacaagccagatatttgaaattcctattaaactggagagcaaaagccgtcataccatactttcatttgcatcctagcacagacacctaaacattcatattgtctttatccccagtgaattgcaaaggcctagggtttccccagaatttgggtttacagtacacactccctgagcgatattcc

SEQ ID NO: 89754 - DNA, 420 bp, Homo sapiens
ccttccttctccagcctgccccctgaaactctggccattaactccctcaatttgctgagctcactacagtggcacagagaagattgaggtggtccgggaccctaggttggggtccagttcccagctgggttcaattttttttagggtgaatggagggagagttggggactgaaaagccttcaaagacaatgttattacagcagtctccccttatccaaagtttccttttcctgagtttcagttagctatggtcaaccgcttggaaaatagttgaacacagtacaataagatattttgaggctgggagtggtggctcatgcctgtaataatcccgggactttgtgagaccaagtttgaaggatcacttgaacccaggagtttgagaccagcctgggcaacatagtaagacctcatctctac

SEQ ID NO: 89755 - DNA, 445 bp, Homo sapiens
aagcactgaggtatggaggtagaaccaggtaggggcagcacattagcagcccaggaaggaaaaaaattgaggagggagtggctcccattcttcattgattcagaggttaaaccacaagctagtgagaacatatattatttttgtaacaaaacagaggatgtacaaactttacatagcagattgtgtatgaaagaactcactcttccattcagagttgaagaaatatttatagggtgcttactctgtgccagacactgtgactattatctaggtaacattgcacacaagtgtgttcctaacttctgaagcggacatcattacactctccatgcccctgggtgccatccgaaaaccatgagttatgttatttcacatggcattaaggagcacatggcattccttttcatggaaatctaaatacgcacagatgtctgattgtgcttct

SEQ ID NO: 89756 - DNA, 266 bp, Homo sapiens
tggacagagaagtgaatttttaacacataatctctaaatactcgtaatgcaaaagtagaaatgtctgtaaagtaaatagactaaatttgaataatataacctcacataaaaatacacaatctggaatcaggatcagttgagaaaagctgtaaaattgctgtacataggtatggaattttaaaaaacagttattggtaccagtcaaaattattgctaaactaaaattatatgaaaaaaacataattagcattattataagcataaag

SEQ ID NO: 89757 - DNA, 411 bp, Homo sapiens
ctctatgagcctaacaagcctggctggcacatatcctgtgcatttaaactcatttttctttacctttccctctttctcacttctactgccccaagcaggaagggttgaccgcctccttttcaaacttcagatccagtcttcttactcctagaatcttctctgctcaacatgccatagtactcttacacttttctgaattcacagtggttattttgaaattaatctcacactgttttgtcatttcttctgtaataatttaggtttagtatagtcaagagtttgggttctgaagtcagatttttggcattaaattctggctccccctcatttctgatatttgaccaaattacttaatctgctaaccttcagctcctttgttggtgaaaagaagattgtggtgacagttacacc

SEQ ID NO: 89758 - DNA, 199 bp, Homo sapiens
agtttctctggcttcccctcacccacacctctcttctgtgtctcttctgcctccaaccagagttaaatctcttaagtgctcatgtgattacatggagcccactgcatgaatcacgatcgtctcctaaggtctgcaaccttaattacatctgcaaaatcccttatgtgatgtaacatattcagtttccagggcatcttgg

SEQ ID NO: 89759 - DNA, 214 bp, Homo sapiens
gctagaggatcccgtactgtggtgtaccgtcccaccagagtggcacagtgactagcctagagtcacatcacttttgacagcagatgaaggaccacattctagttttcttgtgcccaaatcctatgccctttcttccttagtggaagaggagctggctggaagcctttttgtcctcctttcaaacatactttcacactggggaaaaaaaatgaat

SEQ ID NO: 89760 - DNA, 382 bp, Homo sapiens
aaaagctttctacactaattggagatacagatgaaatgctggtggaacgtgttgctttttgcttcttatttttgcttttgactacttttggttctttatgtgtttctttatcccctcaaatttcttatttttatagttttaaatagatttgtaacagaatttaaatgcagaaaaagaaatattatttgttataataatatagtaagttaggcatgtatatgtattttatttctaaaaatttcttttattaaaatttgctttctctaatgcttttattgtcattttacacgaattattgttagatatttttcaatgattttttatagattttttataccagtgtaccatctccaaaggttcttattatgccttaaattgtaaa

SEQ ID NO: 89761 - DNA, 1474 bp, Homo sapiens
aatttccttagtgtgcaattgtatcttacaattatcttattaattttttatataccaaacctagaataatactgtatacatagttggtgtccaataattaattaattttttttcctgcaaatatggaggcagtagaaaaaagaaaaaaatacttttatttttcttaacacaggacagagaaacttggaaaaggaaagggcttaatggagaacttcctttttcctaactacactattgggagttttagagacagccaaatagagaaagttctctccagaggagctgatcctttcatcccaaagaatgcaacagaattgtttacattttggcattgagccttctagtcagttttttttcctgtaactaactatactacacatgtatatgatatattaatataaatgagaatatatgatttggcacctttcccaaagtactatccttcaagcatattttatgtttatttttttgacgttagttttaatagctgcacagtatttcattatgcataaaccatttttgtcttttttcttctcttaagacagtgtctctctctgttgctcaggctggagtgccgtaacgggatcatggctcactgcaacctctgcctccctggctaaagtgatcctcctgtctcagtctcttgagtagctgggactacaggtgcacaccaccacaccggagtaatttttgtattttctgtagagatggggtttaaccatgttacccaggctgtcttaaactcttgggctcaagtgatctgcctaccacggcctcccaaagtgctgggattataggcatgagctactgtgccgggcctgataaaacctatttttagtgaaactcttgctcttctacatatttccaatttttagccacaataaacaaaaatatgttaaaatagaatcaatagaataggattttgtatattattaaatatatgatgaaaatgaatggtggtaatctaggatgaggaccaaatttcaaacttggataagcagagctatgaggataatgaggccagtcttggtcctgctgggtttgagccacctgtggaatacttagttcatatagtatttggaagactaattactgcacttcttgttatagactgatttaccctcctccctgctgcatatgttgaagtccttgaaaatatgactgcatttagagttagggtcgttaaagatataaaatgaagttattgaggtgggtctgaatccaatctgactggtgtccttataagtaaagaagactggacacacacacagagaaaagataatgtgaagacacagggagaagacagttatcgacacaccatggagagagacctcagaagaaatcaaccttgcccacagggttaatcttaagagtcgtagcctccagaattgtgaaaaaataaatgtttaagccactcagtctgtggtactttgttatggcagccctagcaaacgaatacacatctcaaacattt

SEQ ID NO: 89762 - DNA, 418 bp, Homo sapiens
aaattgtagacaatgttagcaattgtctgcaattgaatgactgttagccatatttccataatatctggagatgagataccaggcccagctcatgctaaggaagatgtgataggaagaataagggcctcccaaagatgtctacattgtaatttccagaacctgtgaatatgttaccttatatggcaaaagagactttatagatgtgattaagttaaaggtcttgagatgggagagattatcctggattatccaaaggaactcaatgtaattacaagagtcttttgaagtgaaagaggaaggcaggagacttagagaatatgtgaccagtgaagcagaggctggagtgatgcaattgctgtctttgaagatagaagaaagcaggccaggagtcaaggaatgcatgcagcttctagaagct

SEQ ID NO: 89763 - DNA, 435 bp, Homo sapiens
aggctgccttctgtaaccttttagtcattgcaaacacatagtagatgcatgctgaatttgtgagcttggcaccacacatgacaggctttggttagggaattcagctgcaagcaaccaaaccctcagagccaaagccaggggtgctaggacctctggccctgcagtggccctgatatggcctttgtgtcctgcctcagaggcctttctatccccacagttactgggacaaaatgtcctatgctttcacccttatgtggctccagatgtaggatttaattttttagaaatctgcaatactgcagcagaaatgtagttatgagtcagggatgtgtatgtgtgtgtgtctgtgtgtgaaagccagtctctcagcaccagctaaaaatgtgaagcagcaagtctgtgctgggaattgaggacaccatatgcttgcatttc

SEQ ID NO: 89764 - DNA, 198 bp, Homo sapiens
accatttggcaccaaactgaacatatcatatttttcttctcaaatacttgcactttgttctgatttctgtatttccattaatagcattattaatctcattgtctaatataatcatatattcattgattcattaattcatttgaggtacattgatattcttctaagtgtcatacagtgtgctgcctctgaggatgtaat

SEQ ID NO: 89765 - DNA, 570 bp, Homo sapiens
acgacctggagagtttctttattattgaacttcactgactccctgaggatagactgatcctgccaaattcttgggtccccaataaaacagcattccatgaaataaaaagtaagaacagatggcaccaggaattccactgctgggtatatacctcaaagaattggaaacagggtctccaacagatatttgcacaaaccacgtttgcagcagcagtattacttacaataacccgaaggtggagagaaactgtgtccttccagaagcaaatggataagcagaatgtggtatatccaaacggtggaatattacgcagccataaaaaaggaagggtattcagatgcatgctgcgatgtgggctaaccttgaggacattaatgctaagtgaaataatccaatcctaaaaggtggagagaaactgtgtccctccacaggcagatggataagcaaaatgtggtgtatccaaatgatggaatattacacagccataaaaaaggaaggatattcagatgcatgctgcaatgtgggctaaccttgaggacattaatgctaagtgaaataaaccaatcccca

SEQ ID NO: 89766 - DNA, 699 bp, Homo sapiens
ctggaaaaaggttggtttcactgtggcttcaaagaaaggaggataatgagcttttcactagtaacttctcagcccttttttcattggctgcatgggagggcctgttcccagcgtgctctgggtatcaagagagctgccatggttgccgtgggctagaaattccagcaatcacaggccttcttgtttttacttctatgacaggagaggatttagtgcgtctttctaaaactgttggtgcagtcctgcagagaaaagtcacagttgtctaggtctgatgactgaaaacattccaggggccagccctttccagtttccacctctccactgctgttggccccgacagctagcatcagtttctggctgtatcaggtagctagcctctacaaggtgtgttctgtcaggaaaactactgacctgttggtttcctaggagaaggttgagtttagctacttaaatctgtggccaaagtataaaataaaataaaaaaattttaatgtagtatccatagagatttctcttcttgagtgtttttgttttgttttgtttttttgagacggagtctagctctgtcgccgaggctggagtgcagtggcgcaatctcagctcgctgcaacctctgcctcccgggttcgagcgattctcctgcctcagcctcccaagtagctgggattacaggtgctcgccactacacccagccaa

SEQ ID NO: 89767 - DNA, 273 bp, Homo sapiens
cttttagtataagtgtatcccaaagcatcttccatgtgccaggagtcagtctgggtttggataatccacttaatacacagactggtgccttccaaggaactggtcaaacacgaaggtcagagtcttttgtggcttgggagacacaaacaggctgcaaaatccacttcaaaatccacttccaggtcaggcacagtagctcatgcctgtaaccccccaacaatttgggaggctgaggcaggaggatcgcttgaggccaggagtttgagaccagcc

SEQ ID NO: 89768 - DNA, 321 bp, Homo sapiens
ctcgtgcgcccagaaattttatgctaatattacatagaaaacttgacagatgaaaaaagtgaaacacattactaattttattcattaaaacaggtatataaaagtcctctttaactacctaatgaatgtgtcatatcctaatatagggagtgtcatagtgttcacatctttgaatatataaattatctcaaacagttaaaaaattaaagccagaacagggtacaaaaataagaataaaaataagaaaactttctgttcacaggacgtaacagaatactttaaacactctcaagttataaataaaactttttcattattatt

SEQ ID NO: 89769 - DNA, 239 bp, Homo sapiens
catgctctctcctgcccaccatgtctgactaaattttgtatttttactagagacgggctttcactatgttggccaggctggcctccaactcctgatctcgtgatccgtccaccccgacctcccaaagtgctaggatcataggcataagccaccacacccggcctcttttttttctttttcttttttttatctggagactgagttttgcactcgttgcccaggctggagtgcaatggtgc

SEQ ID NO: 89770 - DNA, 399 bp, Homo sapiens
ctgactaggagacacaatctatacaacagcccactctgaaatctccttgtctctaaattgtcttaattacatctgctggcatttgacacccagtctctaacactataaacttctgatgaaaaaggatgtggtttattctattttagttactatagcagagccccaaaaggcataaagtcattcattaaacacagagatcaaattcacaaccttactctgtctaaccaagtgagctgtgtggttaggcagtacaagtggtatataactgatacacaacaggccaaagcagaccttgaacacctataaccatcagaacaaggaccaaacgataacagttccaacagatttacttgctgagaactatagaatctggtacatctctaatgaggagggaggcaa

SEQ ID NO: 89771 - DNA, 270 bp, Homo sapiens
ggtttttaaatttttaggcttatagtgaaatcttcaatatatgtttagattatttttgtatatgataaaagcaaggggttcaattcaattttctgcatataagtagccagttatcctagcactatttattgagtatagaggtttttccttattgcttgttcttgttgactttgtcaaggatcacatctgagctggagccatggcagaggaacataaattgtgaagatttcatggccatttatcatttccgaaataatacttttataattt

SEQ ID NO: 89772 - DNA, 492 bp, Homo sapiens
tgcctttgtttttgtaaagaccacgtcttgctatgttgcccaggctggtctcaaattcctgggctcctgcgtcacctcccaaaatactgggattgcagcattttgaaccaccgcactcagctgctttttttataaaaagtagagatggggtctctctctgtcacccaggctggaatgcagtggcaccatcctggctcactgcagcctcgacctcccaggctcatgcgatcctcccacctcagcctctcaagcagccgggactacaggtgtgcatcaccacaaccagccgattttttttttttttttgagacagggtcttgctgtgtcacccagggctggagtacagtgggcacaatcatcgctcactgcaacctcaacctcatgggctcaagtgattctcctgccttagcttcccaagtagctgggtctacaggtgtgtgccaacacacccggctagtttttgtattttttgtagagatggggtcttgacat

SEQ ID NO: 89773 - DNA, 406 bp, Homo sapiens
gtttgtacttttaactgatatttattcagcgatattgattaattacctaatatgtaccaggccccatgctgggctctgaaatatagtgatgagtggaaacaggcatgatcccagttctaatggagcttactttctaatgggcgagacagaaattattaatataatcaaccagagtatgcctttgaaggaaaggaacacagttctctgagataatctaacaaaggaaatgacctactctaggaagacagggagacttccttgaaaaggtgtaatgcaactgagatctgatgggaaatattttccgaccgtattttagatagaacagcatgtgcagagaccctgtggtagaaggtgctgcagaggcagagagaggagtcagaccatagagtcctatggtcacattctc

SEQ ID NO: 89774 - DNA, 366 bp, Homo sapiens
ttactggcatttggctagatgatgtgaaaagaaagtaagagtgggagagagggaattcttgtgtatctgtgctaccaagagagtgtgtagtttagtgtactgtattgtatctctgtgcttaatgaagttgcctgtggggctgctcaggagggcatgcgaggttctagctaccctctcacccttcttcgtttcaaccctgtagactcctttaaaaatctattttatttattgggctttctcatagcatttcctatgaacaatggattttgcaatttaaaaacttcagtatcacctgtctagtagaattatatatatttacatatatacataagtagagtgagaatcttacacacatagaaactgaga

SEQ ID NO: 89775 - DNA, 302 bp, Homo sapiens
ttcccttggcctcccaaagcactaggattctaggcgtcagccactgtgcttggcaagattttttcctatgcacttaaaagtagttataaaaattttaatttaaataccaaatgtctgctgggtaagaggtttggctttgcttagctctagactggaattctgttgtttgtgtcttctcattctgggaccggggctcaaggagcagcctctgtcagggctatgacagagtgtaggagagagagagagatggagagcagttgtaagtttctgctcaattgtggcacattatcacatcttctcat

SEQ ID NO: 89776 - DNA, 341 bp, Homo sapiens
tgccattctcctgcctcagcctcctgagtagctggggctacaggtgcccactgccacgcctggctaattttttgtgtgtttttagtagagacagggtttcaccatgtcagccaggatggtctcgatctcctgacctcgtgatccacccgccttggcctcccaaagtgctgggattacaggcgtgagccaccacacccagcacaactatatatatttcttaagtctgtaatagtctagtaagagaaaaatatgtatgcaaagaactctgtaattctatattcacatttatattcaatatttatcgatcagccactatgtgccaagcagtcttctaaatactg

SEQ ID NO: 89777 - DNA, 316 bp, Homo sapiens
gtacccaataaatatgtacaactattatgtatcaattttaaaaagatttaaaacatgatagaaaaaagatatgcctataaaggaagtgtgaacctacagagatgaaagaaaattgtttgtggtgtggttagtgcagttaggggaatttccagaagaattccatttcagtgaatgatgtcatttgggcattatgaaaaatagcctagttagagaaaaaaacagagtttttgttttgttttgttttgttttgtttttttgagacggggtctcactctgtcgcccaggctggagtacagtggtgctatcttggcttact

SEQ ID NO: 89778 - DNA, 212 bp, Homo sapiens
agaagccccactccttaatacctccacgttggggatgagagttcaacgtatggattttggagagacacaaactttcagaccacagcagatccctgccctaaggggtacatgtaccacacagacacacacacacttctgcctgtgcgaaggtagtcaataggaggagtaatgccagggccattccaagggctgctaaatatggggccacggat

SEQ ID NO: 89779 - DNA, 566 bp, Homo sapiens
cacgtggcttttatgagctgtaacactcaccgtgaagatctgcagcttcattcctgagcccagcgagaccacaaacccaccagaaggaagaaactccaaacacatctgaacatcagaaggggcagaccccagacgcgccaccttaagagctgtaacgctcaccgcgagggtccgcagcttcattcttgaaatcagtgagaccaagaacccaccaattccggacacaatattggcaccttgaaatcagccataaagggactacttataccatataaattggaagaccttagaagtccaggtgtttctcccagatatccagtcattaaacatttaccattgtatcactgactatatgtcaccaaaggaatcgagaagaggcaaagtttctctgattgacctagccccggaatttttttttcttggctttgtctttttttcttggcttttctcaataaactgaaactccttgatgtaaatttgggaaattatatgatacagtattatcagttattcacaagttattaatgtcttattataaagagaggcttctctttttaaatccaggt

SEQ ID NO: 89780 - DNA, 347 bp, Homo sapiens
cctgtgcacattggctacccccaatcttccccctaacacatacctgatttgagggtctgacccgtgctccttgcccaagggccaaggttcttgttatagctctgggcagaggtcatccaggaggagccctggaggtcctgagactgctccaggtctagacttgagagaaaggacaagccctctctctgcctcccagtgccttccctctcctgtatctccaaggccctgctccctgtccaatagtctgcccttccccagccaagtgaccccaggcccgaggccatgtctaagatgacctctccctcccaatggccctgggcagccattcctgtggggagcccctgatg

SEQ ID NO: 89781 - DNA, 2321 bp, Homo sapiens
gtaatttcaggagcacagtaagtgtagccccacccaaccccattagttcatttatttcttccacaactggggaggcagtgaaatgctgcagttaaacacttgggctccagaattggactgcacgactttactctccagcttaccacttgccagccgtgtgacacgggtgagttactcgacccctctaagcctctattttctcatttgtaaaatggagctgataatattgtcttccttacagagaatcaaatgagataatatgcttggcatatgattgcccttgaagaggtttcactttattgaaggagaaagacaaatatttttttgtaattactgtatagtgagtatggtaggtgctatgaaagaagttgttgaaattttaaacttagagtttcatgtctttttcagggtataacataagtggttaaaatagcaaggactttgaagtcagacctgagtttaaatccaaattccaccagctaaatgaccttgggcaagctgcttcactttcgctaagtctcagtttcttatgggaatagagtaggatgatgattttatatagctactaggacacagtgagccttcaataaattgtgaccgttactattattgttattcctattattagtcaagtttgatacctgggtgatgcatgtggtttgtaaatatttatattttgttttgacacagtgaaggaagacaagggaggaattggtgaaggaggttaggaaagaatttcgaggccactagaaacaactgcacatctcccagaaagagctctgcctgtgggcagatcatacttatttcttgataccttttttacctgcaagtcctcactggactcagtgggtagacaggaggctcaggactggatagaagaggctcctaagttagcaggtgcagagtgtgcagtgagtacccaggaacaaggtttgcctgctgaagaagggtactgtgccaagtctgggtgggggacagcagggagcacactttgtgtgtgtgtattcttgccttctctgctctgtagtaggcacctgtccccctgcagccagcccggtcctgcctttcattgcctgaaggaactgctactgccacctggcacactcagatccatgtcacgggccagggaagtccaagaattttgaagaatattagacacatttgtgattgtgatttagggtagaggtggccctcaggacatctggccccaagaagggtttattgaggttatgttcatccacctaatacaagggctccttggctagaaaatcactctgaaagaggttctgctaattataggaaaacttggtgaacgtcagagcataaacaagacactgccacaacatcttgtggttctcaatgccaggatacaatgagacatcccagagtccagccctgaaggggttttcgcatcctctgagactggaatcagaaggtgtgaatagaaatggaagcagtggcctgtttcatccccttctctcccctcccctgtcccatcttttttcctcagggctctgccgacccattctgctgtttccgtattcccttcacagcagctcccatcctctactccttcccttgtctacctctccttgaaggaggagcctttccaatacacccttccctgtgactccaaccttggtaaagtcaccaaccagctggactcctccagacagctatacacttgcagcccaaggctggggagtagaacatggctctgtggccaagctgcagctgggaagagactggcaatgaaagggactgatttgggctgggaacaaaacagcctcaaatcaagggcactggacacagcacagacaatggcatttgctaagctgccaggggctcttggcaagagccacatttctttccactttattaactcccttgaggagggataagccagggctaggatcctgagcaacacatgccctggagaaggcccgagataggatacccagagcctgtgcagccccaccctagagccttccagcctcccaggcttcctaaacccattttcccaaccagtgcccgtaggcaggactatgttccatctgagccatggctgtcatctccctagtcactcatccactaggttccctagaagtgcaggctgcaaatgtctatcccaaatcctccctaccatagcaaagtaggatctccccttggtgaacgtcagctagagctgccctggaccatgccacactggctgtaaagggctttttcctggtctggattacatagaccaggaaaaagctactgcactctagcctggatgacagaaggagaccctgtctcaaaataaaaaataaaaaataaaa

SEQ ID NO: 89782 - DNA, 571 bp, Homo sapiens
attcacatagatgttgacaagattcagttcctcgtgggttgttggactaacggtctcattttctcattatctattggccggagcctccctcagtgccttgccacatgcacctctccttagggcaaaccagagaatggcattagattccatcaagatgagcaaggaagagagcaagtgagggtggacaagacagaagccagagtctttttatagtcttatctcagaagtgacatctcatctcttgccatattctgttcattagaaaaatgcaagttactaggtccagcccatgctgaaggggagggaattatacatgcataccaagaggaggggattcactgggagccacctgagaagctgcccaccacagtcaagaaagtgttctcagaggatattgaggactatgttcagttgactctagtctatatgtctggctgcagaaaatttcctgaatgaatgtcttatggtagcctccatcctaattcaggcagagcctaacattagccagaatgaacatgccaacctccagcactgcctgagagaagctgtaattctgataaggagtcatcta

SEQ ID NO: 89783 - DNA, 478 bp, Homo sapiens
caggatcacatcttttgcataaatagccaagaagggcgatgagttcctcagagtcacagtttgctatttcagatggaatctatactaggggagccattctatagcctctgagaagtgctgagatatcaaaatggaaaaatcggtgcaaaataggccagaacaggccaaaaggcactgtatttgacagggaacaatgaatgactcgcatcactgaagcggggttgcttgctctgcccctttagagtggccacggggtctggctgagctccagggcagatggtggcagtgtttccagatgtcctgaccagacttacccatagtgcttgacccaatgcctttaaagttgtgggtacttagcaggcaattgcagatttagttgaaatgttactagattcataacacatactgttctcagagcatgatagaactagtaagcagataaaaaggattcaagattttactttctctaattgttagg

SEQ ID NO: 89784 - DNA, 347 bp, Homo sapiens
tgaaaagatgttcaacatcattatctatgagagaaatgcaaatcagcacaatgataaaaggcctagttcacactactaggatggctatgcacacaaagataatacaagtgttcactgacaaggatgtggagaaattagaactcacacactgctgaaaggaatgtaactgggacagctattttggaaaacaagtctagcagctcctcaaaaagttaaacgtgaactactatgtaatccagcaatatcactcttgggtatataaccaagaaaaatgaaaatatatgtccacacaaaaactcgcacacagatgttcatagcagcattgcttgtaataaccaaaaagtaga

SEQ ID NO: 89785 - DNA, 415 bp, Homo sapiens
tcctccttcagtcattgctctggggtgacagccccttagaagtccacatttctgtgaccttggcctagaatcttaaaatagccctgagaaagagggagggctgagcccagagccaaggccaacagtggggcctgggccaaggaaggggagggcagatgagcctgtccaaggaacaaaggcttcatctccctagtctggctgcccaatctgggtcctctgctcagtcacgtacattttattttttctagactcaggcaagtactcctggattccccaccctaccccctgcccagacagccaggggaggagggatctctcacaccagcttctaagtcatcctgcagctctctgtccattgcaggagcatccatggtgaaatatgtgcatttatgcagagtggtgatattgcgggggt

SEQ ID NO: 89786 - DNA, 421 bp, Homo sapiens
gcctgatagctccatctccatttgtactgttattccagtagcaccacagatatctggtgcttctctttcaaactctgcttatttcaggtcattctcccttctttgggttgttatcttctcctgtcccagcatggatttccagggacagctctgtgaagcagactttgctaatcagaccccactcaagacacgtttccctggaccagaccctggttggtggggcagctggctggtggggcagctgcagggtgtgaaacaggagcagctgggctccttaagtgtgcagagggagctgctctgagaatgaagctgatgaacagaaagaagcaagagggagggatgagaattgcctcatctctttctctaaggcctcccgctagcaggaaaatccacatgagccaataaattgttccttctgtct

SEQ ID NO: 89787 - DNA, 423 bp, Homo sapiens
ggtgaagatacagagaaattggaactctatactgctagtaggaaaattaaatggtacaaagttaacccttttttcctcctcacccccacatccagccacaatattacaaattttacctgcaaaatatttctttaatctgcatttgactctccaaactgaattagacctctcatcaggattagagtaagaacctcttaactggtctccttccctccaagggtgtctttctcaaatccattctccagatagctgctgccatgacctttcaaaacattctcctgctctacacgtttccaggctccccatgacctataggatgaaatcaagatccaacagaagtcccaaggccctccatggcgaagaggacttctcccatcatcctgactcctccttcgtgctggctcttctgtcaatgagattttg

SEQ ID NO: 89788 - DNA, 255 bp, Homo sapiens
ggtgatagggtcttgctctgtcacccaggctggagtgcagtggcatgatcacagctcactgcagcctcaaactcctgtgctccagtgatcctcccacaacagcctcctgaatagctgggaacacagacacatgccaccacacctagctaaatttttttttcatcagcagacaaagctataaaagaaatgaaacaaaaatagatcacttgaatccgcaccactgtctgtgttcataaagaaagtgacaactacact

SEQ ID NO: 89789 - DNA, 227 bp, Homo sapiens
aaaattatcattaaaaatatcatatataaaaatgggaaaatatttttaaggagaatacaaaatagcagcatgtaatcatagctagcaaaaatgatgtattgatttgtaaagatatgcaaagatagaagatatgtaagcataaacattttggttgaggacattacagaaattacaaatattcaaatactttagtgtcattgttttctcaataaatgttttaattaatc

SEQ ID NO: 89790 - DNA, 388 bp, Homo sapiens
taaacttttaaaatccagagtgggttaaaatgcttattttactcaaagactgtttacactgcactgttgaaacatcagattatcaagttcaagtctttaagggaacatctcttttgacatcttaaaatttaactcgaaaagagtttctttaagctgttaggtgtaaaaatattttaactttcttatttcaaattttaaaaactcatacatatcagttcatgtattcatttcattcagtaagtatgcaatgtgcatatactgtataccaggcattgtgctaagtgctgaggcttctaaggtgaacacaatttttggtctttagatagttgagattaagaaagttgtgcttttagtcactgttttctttgccgataactgagcacattgt

SEQ ID NO: 89791 - DNA, 406 bp, Homo sapiens
gtctaacatatagtctatcctcaaaagtgatgtaagtgctgaggagaagaatgcgtattctgtagctgttggatgaaatgttctgtaaatatctattaggtccatttggtctatagtgcaaacgaagtctgatgtttcttttttgattttctgtctggatgatctgtccaatgttgcaaatgtggtgtagaaggctccagctattattgcattggggtctctctctctctttagctctaataatatgtgctttatatgtctgggtgctcctgtgttgagtgcatatatttttataactgttattatcttcttgctaaattgacccctttatcattttacaataatattctttgtctttttaaaataggttttgtcctgaaatgtattttgtcttaaaaaaatatag

SEQ ID NO: 89792 - DNA, 442 bp, Homo sapiens
tttctcaaggcaatctgaagatgtcattctaagcaaagccttggtaaaatacccagtgtctccaattgtgtcctgctataagatagaacaaattctggttgaacctatgtaaataactatattgccatagattaagaataccgacagatagttttcaaatttcggagaaattaagtagagagaaaggaattatgttttaaattttgctcataaaaatttaccttaattgtttaagagtgtaaatatcttaaaagaagaaaaacaaaacaaaaataatcaaatgttttaaacaaagagtcataaaagattatttcaggccaggcacagtggctcacatctgtaatccaagcactttgagaggacgaggcaggtggatcacctgaggttgagagttccagaacagcctgaccaacgtggtgaaaccccatctctactaagaata

SEQ ID NO: 89793 - DNA, 249 bp, Homo sapiens
tcctcatcaacactgtaataccaactacagaggaattattttccattttccaacttttttgtgtttaaaagttttattttataacttacatcttctctttgtataaaaatcacaagcagcatttctcagattaattttaagaaatacattgtttaaaggtaaggtgctaaatttttggaaataggagtgaagacctatttcaatcatgtctctgtaataatggaatccagatttctgtaacaaggtagg

SEQ ID NO: 89794 - DNA, 364 bp, Homo sapiens
ctctatatcatggagctattaggtggcagagtctggattcaaacccagttctaccagagtagaaagtcatgatctttccatgactgctttcattgtttcatctagcatttcttcataagcctaaaattatctattggaaaattagctgattcctacaggctttcatcaaaggcttactttgcaccttttttttttttattattttaactacttaggcccccaatatttttggaattttataatcatgaaagataagctcaggaatttcagatgataaaatagttctaaaatagtttgtattacatgataaatgcaatagaatgctaatccttgttctagaaaatttcaagatgttcacttaaaa

SEQ ID NO: 89795 - DNA, 627 bp, Homo sapiens
gccacaaggacccaacaccggagcacccagatatataaagcaaatattcttagagtcaaagagagagatagtctccaatacaataatagctggatacttcaacaccccacttttggcaatgaaagaatattccaaatagaaaatcaacaaataaacgctgggattaatatgcactatactatggctgtattactatcagagaaagtatattaagatatttgataaagtatcacatttcataacgataaaaggaacaatttcttaggaagatataaagattctaaaataataacttcaggaactataaatcaaaaactgatggagctaagggggaaatcaaataggaagtaacatatactccaataaagtttgtttttcaagagaactatattagaaccatgattgcaaatattgtaataaaattttcctctgggagattgaacatagggtttatattattttcaaggtatttctaagaatttgtgtaaaaatcatggaatgtccatgacttcagactttgagaaaagtgtaatatataatccatgtgtggtgctttgctatttctgtgtgacctgctgtgaatttttgaggttagcatttgggaggtggtaatgttgggtacttcca

SEQ ID NO: 89796 - DNA, 441 bp, Homo sapiens
tgttgcccagatagtcatattgcttctttgcaatatcaattcacagaggctgtgagatgtggttcaaagagtggagtcgagagtctggatgctaatcctgcctttgctgcaagaacccttctgtttgttaccttgaggaaggcaaatgtctgtaggctttgcatatctcatttgtaaaatgaggaaaggtagctgtaaaattttctaacatccgaattatataaactttagacatagtataaaataggaaactaccaatgatttctaaagataatatagttctttcagaccacaaataatacataataacatgcaactaagaacaacttgtaaatgcaagaaaaaaacaaataattggaaatcagaatatttctgggaattcttcgtaataaagcaaatttcaagcacaataaagtaatatttatgcatatttacatattt

SEQ ID NO: 89797 - DNA, 193 bp, Homo sapiens
gatcctcatcttccccaaatactcgttcccaaaattgacgagcctgacaatgtgcatgccaggcaaggctcttggggttcccctaaaacacttcctcttttaagcctaccactcactcatcatgaatatagtccattgtcccagggtgtaaaaccctctatagtgttaaataaaagaatgattgggaacattg

SEQ ID NO: 89798 - DNA, 439 bp, Homo sapiens
tctttttcataccacagtgtacagcaaccttaggattctatgtttaaaaaatctgattttatgtcattatgagattgatttgtcaatcaaaataccatcattaaaggagagatattatttaacaatgaagttaaacatgaaaatcagctggctcttttatttaataaataatgaaatagcaatctatcaaaaatacctccataaataaaatatacatttagttatttctttatgtacatagtaagctcatttcaatgtttagtttcttttatctatcaatagtatatactaatgcaagtgctcacgtaaataaaaacaaaacccaaatacctttaaacatttgaatatttttaaaaagtatacagaatattcaatttaatatgtattttatcctactacagtaaattagagaagagatgaaatctattttgcttatttg

SEQ ID NO: 89799 - DNA, 419 bp, Homo sapiens
  misc_feature (13)..(13): n is a, c, g, or t
  misc_feature (23)..(23): n is a, c, g, or t
  misc_feature (48)..(48): n is a, c, g, or t
  misc_feature (82)..(82): n is a, c, g, or t
  misc_feature (85)..(85): n is a, c, g, or t
  misc_feature (88)..(88): n is a, c, g, or t
  misc_feature (115)..(115): n is a, c, g, or t
  misc_feature (153)..(153): n is a, c, g, or t
  misc_feature (160)..(160): n is a, c, g, or t
  misc_feature (265)..(265): n is a, c, g, or t
  misc_feature (314)..(314): n is a, c, g, or t
  misc_feature (330)..(330): n is a, c, g, or t
  misc_feature (332)..(332): n is a, c, g, or t
  misc_feature (341)..(341): n is a, c, g, or t
  misc_feature (344)..(344): n is a, c, g, or t
  misc_feature (356)..(356): n is a, c, g, or t
  misc_feature (379)..(380): n is a, c, g, or t
  misc_feature (405)..(405): n is a, c, g, or t
cggtgcgtgtggnagagccaggngccggtgtgtcttgtgggggtctgnagcccactggccggggtcttgaggtgggtggagngtncgnggtctcaatgtccccaaagaaggtctngaaaacccctttgcctctatgtttctagatgtcttctnatccagnacttgaattcctcccacttaaccccaccccatcgttctcactaacacctgctatgtgccaagccctgtgtcacgtgggaaggtctcatgggtgcaggaagccctntagttaaagcccaggttggcccaggtggaggcaagctggcatcactgcntgtcagcggattcaancncgactgacngtngtcgggcgggtntggggtccgatcgccgccagcgnnacccatttttatggagctagttgantgcgactaggtgag

SEQ ID NO: 89800 - DNA, 579 bp, Homo sapiens
tgttgtggtaaaaaatacgtaaagaaaaatttaccattttaaccatttttaggagaacagttctgtgacattaagttcattcacattgttgtgaaccatcagtgcatctatctccagaactttttcatcttcaccaaatgaaactctgtactctctaaacactagctccccattctcctttccctccagtccctggtaaacaccgttttgctttctatctttaagaatttgactattctaggaatcacaaataagtggaatcatataatatttctgtttttgcgactggcttatttcacttagcataacgttttcaaggttcatccatgttgtaacagttcacaatttccttccatttaagactgaatcataccccattgtatatgtatcaccgttttctaccccagcttttgaagtgtaattgacaagtaaaacttgcatatattcaaggtgtacagtgtggtgctttgatatgcatatccattgtgaaatgattatcacaattctgctaataacatcattatctcacatggtaactttttttttgtttggtgagaatactcaagatttcttaaattt

SEQ ID NO: 89801 - DNA, 173 bp, Homo sapiens
gtttacagagccctctctcattacatcatgtgtgcccgatgtctacagagccctctctcactccatcatgtatgcccgatgtttacagagccctctttcattacatcatgtgtgcctgatgtttacagagccctctctcattacatcgtgtgtgcctgatgtttacagagccc

SEQ ID NO: 89802 - DNA, 232 bp, Homo sapiens
ggcggggctgacaagaaagcacatctgaagtggttcgaatattcataggattgatggcatctacccctaggtaccaaagccagggaccatccctgtggaaccctggggctcgagggaacacagtttgagaaccctaaaggagaaagctctatggactgggaggcactgcttctgagcagctctcctgccccacactggccccagccatcttcatctcctgcctggaccactg

SEQ ID NO: 89803 - DNA, 434 bp, Homo sapiens
cccgttgatggctatgcacaggtgtgattgtggctcactgaagcccaaactcctgggctcatgatcctcccacttcagccttccgagtagctggtcctacagttgtattccactatacccagctaatttttaaaacttttttgtagagatagagtctccctatgttgcccaggctggcctccaactcctggactcaagcaatcctcctgcctcagcctcccaaaatgctgggattacaggtgtgaaccagcatgcccggccctttaatggtcttattcttaaaccccttattttcacattatttcctcaaaccaaagctctgagtttcttttcatgctcttttctcccccattcctgtctgcccaccttcagtacagtttcctccagggtatctttttgagcgtgtctttcagccattgcactccggccgggcc

SEQ ID NO: 89804 - DNA, 461 bp, Homo sapiens
gaaacttgaatctccatattgtaggggttatttctcttttgtgattatagttttcaaatttcgtattgagtgttgcttactgaattgagtttagaatcatcagttatcataagacttgtgtcattaataaaaatgcagtttgagtgcttcttaacactagtccaaacatttagacgtaagatcaccataaaaaaattcaataggaataataaatcagcatcagaggatatgagggatatgagggcctaagtgggaaatgtgtgtaccaacttaaaacaaagagcttgaaaatttaaaaattacttaaataatttatttcatttatgtgatgttagcaacatgatgataatctgaaatgaagacctcacattcatttatgggggccaaggtaaaaaaaaatcattcaaatcattacttagtgaagggaggaaaaataatatatttctagacagattcgtaac

SEQ ID NO: 89805 - DNA, 386 bp, Homo sapiens
gatgaggaaagtttggtcaacaggcacaaaattacaattatacaggagttctggtgttctgttgcacagcagggtgactagttaacagtaaggtatcacatattatgaaatagctggaagagaggcttttgaatgttctcaccacaaagaaataataaatgcatgtggtaatagatatgctagctaccctgatttgatctttatacaacatatgtgaattgaaatgtcaaactgtaccccataaacatgtacaattataatgtatcaattaaaaatatgaaaaaattataatttgtatagttaaaaaaaaacttcacagtaaattctttgttaaaaagtgcatctgcttttttggcggactatgtggagacagaggcttctcattc

SEQ ID NO: 89806 - DNA, 350 bp, Homo sapiens
gaagttttaaaccttccctcatcttcctgtctttttctgagccttccaaactctttcagcctctgcctgttacatagttccaaaatgacttccacattttcaggtatctttatagtaattccccaccccggtgccaattttctcttagattgctatacagaaatagctgagactgggtaatttataagaaaagaggtttaattggctcatggttctacaggctgtacaggaagcatagcagcatctgcttctggggaggcctcaggaaacttccaatcgtggcagaaggcaaaggggaagcaggcacatcacatggtgaaagcaggaacaaggtcagggggcagatgcta

SEQ ID NO: 89807 - DNA, 744 bp, Homo sapiens
agataatgtcctatatttatactctctgtgttaaaaggactctctgatgcttccagtctatgtttcagcttctttgggtaaggaagtactttcggtcttcttaccatacactttagtaattatcactttcaggttttaagattctttagattatatctctcttatatatatatatcttggtacaaaaggcatgttaatctgttgccatgaatgtgagtttgtctctccagcttctcacactgcattatatgtggtaaattacttttatgtagtaattctttgacatagtccatgacttgctatcacaagggtatttgagatttgatagttatatgagaaggtatatgaaattatacagaatttaaacatgcagatgaaaacattttaacaaatatttgagtgttttcttttgtgttaagcacaaaatatgaggaccacaagggagaataagacgtggtctttttagtcagcctacagttaagttggggagacaaaatatacaaaatataccttaagggataaatattgataaataatttcaaacagtagcatgacaaatgagaaaagacagttgctgtatcttaagatgtagagatcattgtcagggtggacgattggagacgttttgttgaggagaaggaattgaaactatgccttgaaagataaataggaatcgagtcagtaagaaagagaatgaattttataaacaagaggaacattataaaaagctaagtgtcaagacat

SEQ ID NO: 89808 - DNA, 261 bp, Homo sapiens
acccgcctcggcctcccaaggtgctgggattacaggagtgagccaccatgcccggccagtagcttgcttttcttttctctttgagatagtctcactctttcgtccagggtggagtgcagcggcgtgatcttggcttcctgcagcctctgcctcctgggttcaaatgattctcccacctcagctacccgagtagctgggattacaggcgtgcaccaccacacctggctaatttttgtatttttagtagagacagggttttgc

SEQ ID NO: 89809 - DNA, 287 bp, Homo sapiens
cttaaaagatatttaatattgtcaaaatttagagttttaacataatgccattttagtttcaatttatttcaaattgcagaacagttaatactagactcagcttggagctgtttttgtaaaagatctcaaagagactatgttttcagggctcaagaatagccatatttcctcttagtgtaggcctggtttcctctgactccccacctcccatgttgaagactttgtcagaatgtctgtccgctcactcatgtgcttccttattttcttttgtctttgtctggcagaag

SEQ ID NO: 89810 - DNA, 467 bp, Homo sapiens
agaaaaattgaaacctaccaaatgaatgattttatggttgctttttcttatggcagttaagatttgttttaagttagtgatttaaaataaatttaaagaaaaatactgagtaaatattagtacatagagtactcatataacaaatgtcaaaaattcatcatatttgtgaaaccctaatgtataggattaaaagcacatacatcttctaaatccagtgtacagatccttcacatcatcagccctgattgacttttcgacttcaccccctctagctgccatcaattgtgctgtaactcatgtcactaatcaacaggttcttccatgtgacttctcctaactcctttcagtctattcgttacacagcaccccaagggaggctggcaccccaagggaggctgttaaaaagtaagtcaaggctgggcgtggtggctcacgccttaatctcagcattttgggaggccaaggca

SEQ ID NO: 89811 - DNA, 541 bp, Homo sapiens
cccgctttggcctcacaaagtgctaggattacaggtatgagatacagtgccctaaaaacatgtttttatgaccatttcttttgctccaaattgcccacttcttctgctccaaattgcccacttcttcttctagatggagtgataggataaccctgtagttttgagacttcctgtaagatcaagcttctcaacagctccccagagtcgtttgtccctttcagtcaccaaccacaccctaaaaccagaaatgatgaccagataagtgaacaattgagttcggtagccctgtccccacttattctcctcctgctggatcatgtcccatcctgaagtacccaccagcagagaaaaaagaacaccctgagggaagggtagccttggatgagaagcagtcactttccagaaagacagtagctacttcctcttcttagaaaagtaggaaggtcttagaaaggggtgggtaccaggagacagagggttgcagtgagccaagatcatgccattgcactctagcctgggcaacaagagtgaaactctgtct

SEQ ID NO: 89812 - DNA, 864 bp, Homo sapiens
ctgggattacaggcgtgagccactgcacccggccaaacattggaaatttttaatgatggatttcagttcttctcacctctgggtatttgtaatatttggtaaatcaggagtcctgagagtcttagaattttcatgcattttaaatatatgtcttcaaagcacctaggaatatgtaaatagttacccaaatgtgagaacagaattgaactaaaagcttcgtttataattttttttttttttgagacagagtctcactctgttgcccaggctggagcgcagttgcgtgatttcagctcgctgcaacctgggactgcaggcgtgcttcaccatgccccgctaatttttgtttttttagtagagatggggtttcgccatgttggccaggctggtctcgaacttctgaccgcaggtgatccatccgcctcggcctcccaaagtgctgggattacaagcatgagccaccatgcccagccggttaataattcttaatcagtaaatcattattcaaagacatagttaatatcttcatgacttcttaaggatgctcaaaagctggtcttcagaatacctacatttctttatctacatattctgtcatttggagttatacaagtagtaatgacacaccaaaatgtaaataattattgttagcttttaagttggcttccaaattcaaaaaagaaaaaaatcctgaattctctaaaggaacatatgatagagtccatatgttaattcataggaagtgtttaaggtactatggtctattttggtctaatctttgttttactatgtaatatatatttatgatttacaagtttgttattcagtgggataataaatgaacacaaaatttatgttctcaac

SEQ ID NO: 89813 - DNA, 386 bp, Homo sapiens
tcaagtttgctgccaggacagagccctctgagcaagttatacacaagtaattctctcttgagagaaacatctatgaagaagaagaaaaggaaaaaagaagacaagaggaaaaatagaatgcaaaagagaaagaaagaggaggtgttacaagaaagaagacaaggaagatgaataaatagaggatggatgaagactatgtccaaccaactttccagaagaggtcctcttcacagtgacatctatcaagcctttgattaggaatgctaattacttcccagaagaggcccagtaccttttaaactatggaagaacagttctgccccttgccagacttgggaccatattctttctcattgtttccctcctctctatccacaacaaataaa

SEQ ID NO: 89814 - DNA, 1154 bp, Homo sapiens
  misc_feature (784)..(784): n is a, c, g, or t
  misc_feature (860)..(860): n is a, c, g, or t
  misc_feature (908)..(908): n is a, c, g, or t
agtctggtagttgtcgctggccgtgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaaacgggaaaaaaactcaacatgggaaaattgtccccagggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagcaaaaaaaaaaanattaaaaaaataaactggcgtcgtttacacgtcggactggaaaccctgcgtaccaactaatcgcttgagacatccnctttgcaagtggctataccataggccggacgatcgctttcaacattgncagctgatgcaattgaaatgtaccgtatatttgtaaatttcggtaattttgtaaatagtcattttaccaatagccgaatggaaatccttttaataagaatgacggattggttatgttttcccttgacacaacccctttaagacggcctcaactaaggcgataccgtttaggggagcccttcgaccatcctataaagtttgggtcgggccaaacctaattgacttaggagccctttacttgcggaaa

SEQ ID NO: 89815 - DNA, 1239 bp, Homo sapiens
  misc_feature (869)..(869): n is a, c, g, or t
  misc_feature (945)..(945): n is a, c, g, or t
  misc_feature (993)..(993): n is a, c, g, or t
caccctttccagatacacacccgtttagtgcgagaaatggagcggttggggagaggatctcccgagggggctggattgagaatgggtaccatttgagatctcctaggaggccggccatcgggcaatgtctgatggagtccagccggtggaggagactgaaaggaaacagcctgcttcctgcaggtccgcgggagggaggtctttaagtgcgtttgtgcagccgatttcaaggctaagagagaaagactgcctctgatccctgaaggaagaaaaaaaaaaaaaaaacgggaaaaaaactcaacatgggaaaattgtccccagggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagcaaaaaaaaaaanattaaaaaaataaactggcgtcgtttacacgtcggactggaaaccctgcgtaccaactaatcgcttgagacatccnctttgcaagtggctataccataggccggacgatcgctttcaacattgncagctgatgcaattgaaatgtaccgtatatttgtaaatttcggtaattttgtaaatagtcattttaccaatagccgaatggaaatccttttaataagaatgacggattggttatgttttcccttgacacaacccctttaagacggcctcaactaaggcgataccgtttaggggagcccttcgaccatcctataaagtttgggtcgggccaaacctaattgacttaggagccctttacttgcggaaa

SEQ ID NO: 89816 - DNA, 1205 bp, Homo sapiens
tagaaatctgttcaattaaaaatgcttagtttatacaaagatactacacaaaaatagaacaattagtctgaattaacgtatttacatattgcatatggaagataagttcatttatcttcctttctaagacatatttaatgtaggttacatacactccaactattactttgcttttgcatatgaaactagaaaacactgactttgtttttataagttattaaatgtgaaattgatctgcatcagcttatttataaaagtaatgttatttccaagaaaatgttactcttagcattgattttgtatgttagactttttacattgtttatctaatattatttatgacagtaattttaaaatatattattcataagttcaaggatcccatatagtataagaatataatttcacttgctttgaaagttgatttaattgactgactaaatgaaaatgcctacccactcatataacatacctcaggtctattttaccttacactgaatgttcttaatatgatttggtacctaaagtaattgaaaaaaatgcagtttcctttaatccttgactataagttatactatgttgcgtacatggcaaatcctgcaaatatagattaaaaattaaattagcccattgaaatcctttataattctgtcattttcccaaggaagaatagcattgtacatatgcaatctttattttattctttattgcttatcagagtgagtggatgaaaacatttgtaaggctgcaacataatattaaaatgtgaataaataaatgttctgataaaatagaaaagaaagtaaattacagtgatttccatcatattatcactcttgaattttatcatctataaaatgagagataaaaatatctcactgaattgttacttatatcaatttaaaatttgctagtggtttgaaaataataatgtactgactacatgtatgctgttattgtcagtgtttccttctataaactgttctttggaaaaattaagttatacataaaattcatattaaactttttacagaaagcatacatgataaacagtttatggtacttctcagaatcatttcataataagcaatttatttagcttaagttccaacttactgttcttattataaattgcaaagcaacctgtcttacattcttacattatcttaaaataaatatttctgcccttgaatcaaaaaacattg

SEQ ID NO: 89817 - DNA, 2297 bp, Homo sapiens
ctccaggagcggcatcaaacagccccgcggggaacgccgccgcacgcatgctcggacccgcccaggcacgaactctcctggaaaaatgctcccggcggctttcctgcttcctttagcgtgaaccgcgggtgctgtgcctcccgtgaaaataataaattcaccgtcacgcttgttgtgaacgcgggtggttcccgaaacttggaggcttcccgtaaacccagctccttcctcatctgggaggtgggtcccgcgcgggtccgccgcctcctccctggcccctccctctcgtgtctttcattttcctggggctccggggcgcggagaagctgcatcccagaggagcgcgtccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctgccctcatcaaacccacagacccggactccctttctgccaccccaggctggtccggccccaggtgtggggtccgctctctccactcccagggctccgcgcccaagtgagggggcccctgccggagcctcagacacactccagttcagggctgtggggggccttggccacatacctgtcccttggctatgagcaggctttgggggcccttccgcggcagccccgggggccgaggtagggtcgggggcttagaggctgggatggctcctggccccaccgccagggggcagcgcaggccgggctgggaggcggcggcggcggctcgggctggggggtcaggtggacgccgccctccggggctggacgcgcatccctcagtccctcggccacccgggggtcgctccctcgtgcccaccgcacctgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcaggacgcggcggcgcccggtgaccgaggcctcgcacagccggccgccctgagggtcgggccggagccagggtccaagaggggcgcgtttgtgtctcgggttaaaataaggttccgtccgcgtgctgggtcaga

SEQ ID NO: 89818 - DNA, 876 bp, Homo sapiens
acgagatatatgtgctgattgggtcgggtggatgtatacatagttcactgtgtcccttagaggccctgtctcctgccctggccctggccctggcacagcagccagccaatgccctgaggtccagccctgatccgtgtgtgcctctgtctggccctacaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctctgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcaggacgcggcggcgcccggtgaccgaggcctcgcacagccggccgccctgagggtcgggccggagccagggtccaagaggggcgcgtttgtgtctcgggttaaaataaggttccgtccgcgtgctgggtcaga

SEQ ID NO: 89819 - DNA, 1514 bp, Homo sapiens
ctccaggagcggcatcaaacagccccgcggggaacgccgccgcacgcatgctcggacccgcccaggcacgaactctcctggaaaaatgctcccggcggctttcctgcttcctttagcgtgaaccgcgggtgctgtgcctcccgtgaaaataataaattcaccgtcacgcttgttgtgaacgcgggtggttcccgaaacttggaggcttcccgtaaacccagctccttcctcatctgggaggtgggtcccgcgcgggtccgccgcctcctccctggcccctccctctcgtgtctttcattttcctggggctccggggcgcggagaagctgcatcccagaggagcgcgtccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctggccttattaaaaccaaagaaccggatccttttgcacccaggtgtcgccagtgtgggtcgtctctcatccagtcggccatgggggccgca

SEQ ID NO: 89820 - DNA, 1405 bp, Homo sapiens
ctccaggagcggcatcaaacagccccgcggggaacgccgccgcacgcatgctcggacccgcccaggcacgaactctcctggaaaaatgctcccggcggctttcctgcttcctttagcgtgaaccgcgggtgctgtgcctcccgtgaaaataataaattcaccgtcacgcttgttgtgaacgcgggtggttcccgaaacttggaggcttcccgtaaacccagctccttcctcatctgggaggtgggtcccgcgcgggtccgccgcctcctccctggcccctccctctcgtgtctttcattttcctggggctccggggcgcggagaagctgcatcccagaggagcgcgtccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggagtgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcaggacgcggcggcgcccggtgaccgaggcctcgcacagccggccgccctgagggtcgggccggagccagggtccaagaggggcgcgtttgtgtctcgggttaaaataaggttccgtccgcgtgctgggtcaga

SEQ ID NO: 89821 - DNA, 1090 bp, Homo sapiens
aagcaggctggtactggcctgggtttatggatccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggagtgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcaggacgcggcggcgcccggtgaccgaggcctcgcacagccggccgccctgagggtcgggccggagccagggtccaagaggggcgcgtttgtgtctcgggttaaaataaggttccgtccgcgtgctgggtcaga

SEQ ID NO: 89822 - DNA, 1982 bp, Homo sapiens
aagcaggctggtactggcctgggtttatggatccaggagcggacccgggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctgccctcatcaaacccacagacccggactccctttctgccaccccaggctggtccggccccaggtgtggggtccgctctctccactcccagggctccgcgcccaagtgagggggcccctgccggagcctcagacacactccagttcagggctgtggggggccttggccacatacctgtcccttggctatgagcaggctttgggggcccttccgcggcagccccgggggccgaggtagggtcgggggcttagaggctgggatggctcctggccccaccgccagggggcagcgcaggccgggctgggaggcggcggcggcggctcgggctggggggtcaggtggacgccgccctccggggctggacgcgcatccctcagtccctcggccacccgggggtcgctccctcgtgcccaccgcacctgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcaggacgcggcggcgcccggtgaccgaggcctcgcacagccggccgccctgagggtcgggccggagccagggtccaagaggggcgcgtttgtgtctcgggttaaaataaggttccgtccgcgtgctgggtcaga

SEQ ID NO: 89823 - DNA, 275 bp, Homo sapiens
gccaccacacccaacagtaatttcttaaccagagggcctgggagtgggtggcaatcagaggagggggagacttgtgatttgaaaagacattctaagatttaaaagtgcttttaatattttttagtcatgatatttaatttgtttggaaatttcaaataacgttaaagaagaaacttgtttgtcaaaggagtcaaggggtgagagttgagaaactgtgatctacaaagttgatttaagccaaatcggactaaagggcagattaattccacattctg

SEQ ID NO: 89824 - DNA, 450 bp, Homo sapiens
agtgaaaccatggaaaacaaaattgtggctaagatcggggacgactgtatatgtattcagtgctatacattttattctaagcaccgcttcgactgcatctcacaaattctaagttgtgttttcatttcatttagttcaaaatatttttaaatttatcttgagtatttcttctttgttccatgcgttgtcttgtttacatctcccaggtattttgggatttgccagctctctttccattactgctttctagttgaattccattgtgattgcagagcagaccttgtattatttctagtaaatttattaagatgtgttttataactgtgtattgtaaactggggagtaaatgcccttcgtggggtctctaggatcattccaacactgccgtggaaatgaaactctgagaagcataaaggatttattatattcataggtcctcatagagggtgg

SEQ ID NO: 89825 - DNA, 471 bp, Homo sapiens
gggacgagggacatgtagctaataggaacatgaaaggagaaactagaaaaggattccacccctgtgatatgcacggaccggcccagccacccatgtggacgctctgtctctccgtgtctgcttctctttctctcttctctctcacacacatgcacgcacacatgcacacatgtccatgtgcacacacgtgtagccgcatccctcagctgccgcttgcagtctaaggatccccttagcaggcagccacctttctcctgggttggggagtggtgggactgaacccccaccccttgtgcccctgcacccgcctcctgggcactccatctactccagcctcctgcctgtgtctgccatgctttgttctctagttgtttccttgccacctaccagtctcctcagctacaaggaagtttcagagaaatcacttttcttcttcagaacctccacaccatcccacccatcagactttcc

SEQ ID NO: 89826 - DNA, 397 bp, Homo sapiens
ggaagccaccaggcacacttgcttactgacgtgctcgggggcggtgaggtcccagtctgtgctctgcacacagcaggaataccatagctatcgacaatgtgactgaaatatttctttggcaaatagaatactgtgtttgttaggctgatttctattttaaaatagaaaagaagaggtttcaagtgagtttttggttctggtgaatcttcattagttctacacagtctgtgggaagcacctcttcttccagggccaacaaaccagggaatacattcatctgtgtggggtgggctctatggctttcaggacctctgcaaaacaaagatggcaccctgcaatacaagcctgaaacttggcgagctgtaaagttcagccaggcaggaggtgtttgcaggca

SEQ ID NO: 89827 - DNA, 478 bp, Homo sapiens
gagagatacagagattaacattaaatgtatttaccctccaagaagcatatattctgtatgtttagggaagataaagaaaacaaactctgcctctttttatgggttcttgctctatgactatgtgtccttttatttcattgggagaagggtgagagtagaattggaaaaggtacaaatagcataatcccaaaatgagttaccacttgacaaattagcataaatctctttcttccctggatttggggctgacagttttacataaatttcataccgtatgttgagatttacttccttaagggtttttcctaggttctctttgacatacatagattgagttgtttacttttcttagctaaattagagacccgtatctttttggatttttcttaagtgttaaacagaaagtaaacaagttcatataacacaagaccaacaaggctaagactgcacacacacacacacacacacacacacacac

SEQ ID NO: 89828 - DNA, 427 bp, Homo sapiens
cctcccaaagtgctgggattacaggcgtgagccgccacacctggccaaaagtaaacttttctaactggatgcagtaaattccaaagtttatcattcaaacactcaaacaataatatttattatgaaacaggagtacaaaccattttactgtgtttatgaatgattctactcagacttatcttcgtaacacaattcataattttcagcattccagacttcagctttggaacagaactatgttctgaaatcttgacgtttgcttatctctgatctgttttcaccagtggctgattttatcctaggtaccctccacgtaatgtctcattccctagggccctggcatagctcagcgccacagcaatcagacaaggactctggagctctggagctgtatagcatctagggtgtacccaggtcattccagccg

SEQ ID NO: 89829 - DNA, 526 bp, Homo sapiens
ttttttgagatggaatctcgctatatcacccaggctggagtgcagtggtgcgatcttggctcactgcaacctccgccttctgggttcaagtgattctcctgcctcaccctcctgagtagctgggattacaggttattgaatagcatagttagagattagatattagacatttttccctttgaaatattttaagtgggataacaacaagggcatttaatgctccaagtggctattcccctcttcccctaggtcctctcctacccccctgccccctgccaactctcctttccatttatgtcactgaacatattcagatgactcaattgggtggttgattttgggccatcttcaatggtgctcacacacaagttaggaatatgaaatattttactgtgtattaggaaagagaatgctgccaaaatctactacaaaatctacagggtgtgagttccctgggagcagagttggatgatcttttttggctttctctccagaatctgagccaagtactactctttatgaaact

SEQ ID NO: 89830 - DNA, 255 bp, Homo sapiens
cgtgagccactatgcctggcctcctgtttaagctacctagtatgtgttattttcttagggcagcccaagccaactatatgactccaaaattctaccccccacaagaaataaaacccaacagaaagatacgtaaagacttgtactcaaattttcatagcattattatttaaaaaggagaagcaacccagatgtccatcagctggtgagtggataaataaaatgttgtatgcctgtacaattgaatattggttggca

SEQ ID NO: 89831 - DNA, 283 bp, Homo sapiens
gagctcacgagcctgtgcggggatgacaccatgcggctgctggagaagaacggcttgactttcccattcagtgcgtaccatcccagctccacctgagggcaggcgttgtagaccgcaggccagcataggggaggggctgggtttatagtgccctctggatttaagctcacccgaggatggatgagcacatggccctgggtcccacctccacccactcctcccgcttcatccctctcaagtaatggctcagctaataaaggcgcacatgactccaaaaaaaaaa

SEQ ID NO: 89832 - DNA, 407 bp, Homo sapiens
aacctcccagactcaggtgatcctcccacctcagcctcctgagtagctgggactacaggcctatattaccactcccagctaattttttgtattttttgtagagatggggttatgccatgttgcccaggctgtgtattattgtttaatgttgtattgttatttttttttaatattgtcgatctacagtggtttgaatccacagactcagaacttgtggatatggagggtcaagtcctctgtccagagccattgatggttccttactgcttgcaggacagaatccacaaactccaaatggcatccccatccttggccaacctttgcagcctcaccacccactcctcccgcttcatccctctcaagtaatggctcagctaataaaggcgcacatgactccaaaaaaaaaa

SEQ ID NO: 89833 - DNA, 224 bp, Homo sapiens
gctgcacccattaacttgtcatttacattaggtatttctcctaatgctatagtctggtattttttattttttagagacacgggtatcactatggtgcctaggctggtcttgaactccaggcttcaagcaatccttccgtcttaacctcttaccccaaaatgctgggattacaagtgtgagccaccatgcctgcctatatattgtattttctttttttttttttt

SEQ ID NO: 89834 - DNA, 324 bp, Homo sapiens
ttctgatggtggagaagaccatacatgtgtgtgtgtggcatcagaactattgactcctcctattgatgtttaagatattccattacacaaacctgggttcatactttttgttgatagatcttatgccaaaaatgtaggcaaaaaatgccaagcaggaaatgctatcacttctgaagatgaattcatacagatggaaattctttcagaatttatttttccagcttttttctttgtttgttcgtttgtgtttgtttgttttgagacagtctcgctctgtcaccaagttggagtgcagtggtgaaatcttggctgactgcaacctcc

SEQ ID NO: 89835 - DNA, 177 bp, Homo sapiens
tcttaccagtgagttttatacgttcacatattttcttgttgcatgttagcgtcctttcctttcagatgaggaaatccctttagcgtttcttgtaagacaagtctggtgctacatataaaatgtttggattctaccttacttgtcttggggtcttgacaggacatggcacattctgat

SEQ ID NO: 89836 - DNA, 783 bp, Homo sapiens
gcctccaaatgttttgctaccacataacatgatcttcatctttatagcttcaaaaatcatttttttaaatcacttgtcactcaccactaattgagcagtgggtacaaggaagctgattctggagactggaaagactcgcgtagtgaccaaacacctgcgatggcttaaaaggaagaccactaaacaaggccacaaattttagatttatgttacaacagcataccactttaagtataaacttctacattagttaaaggactgttacagaactggtccgctacagagtatagattttcctattggtaaggtataaaattaggccaaaggtcttttttcctggcccccttttcttcttgtttctcaatgagtagctgcaatagcttgttcagtgctggattagctacctcttggcttggaagagaagcgggagctgagttttggagctatgtggaggtcagagaagaatggatgtctggagagggaaaaagctcacagtggcagaggaggtgaaactggaggtagcctgggggagctcctggaatggcctgctgatttctggggtttggtgtgggtgagattgcacagaccaagttcgttcaaaagggccagagtggtatgaacaccatgaaaaccccgagacggttcatgaatctgaatacttgagtaagccacataagctttggtttctcagcttccaacatcccatttaaaatttgtgtatgtattttaggttcagtgaagaggaaacaaaaataattaatatttcatccttgctaaacaaat

SEQ ID NO: 89837 - DNA, 132 bp, Homo sapiens
ctgaatgcgagtaggaagttatccagaagcaaaactgccacattgaggtgatgcatggtacagactgcatgcgtgactgcgcctgacactgttctgcttcagtgaacaggtatattttagcattaaactggt

SEQ ID NO: 89838 - DNA, 548 bp, Homo sapiens
ttgtatctttggtagagacggattttgttatattgcctgggctggtctcaaactcctgaggtcaagcgatctgcccacctcggcctcccgaagtgctgggattacagctaccgcacccttcatcatctttttctgatatatgtgtatatatatgtatatatatatgtacacattcagcagtgggaactgactgttttttgtcactatagattccttgcttttctgcttgtttacagtagggaatttcttttctgttaacttttaaaattttgagttaggcagacccctccccggccattggtgacaaaatatgaataaactactgcaaattaaaaaaaaaaaaaaaaaaaacaaaaaaaaaaaaaaaaaaaagaaaaaaaaaaaaaaaaaaaaaaaagaaaaaaaacaacaacagaaaaaaaagatagaaaaacaacaaagcagacggcgaccaccaatgaagcatgacaggagagaccacacagaaatacagcggcgaccagccatacgagaaagagacaaacacagaaacaccaacacgagacagg

SEQ ID NO: 89839 - DNA, 442 bp, Homo sapiens
ttcattcaagacttccaaaactttcaaagagattaaaatagtaacactcaatacttcttgccagagtaaaggaatatgtatcacaaaaataacgatttcacatgaaaaacacctagagttgccatcccaggaaacagctaccttaagcacacctttgctcaaatacaagagttcatcctaaccgtaaagcataaaatgctctcatactctgccacagaatcagttcttccctcatatggcagctacaccggcaagaagcatgaatcttggtggcaatgaacagtcccagcattaagtgacatagctgaaaccagaaaattggcctgtattcgactggaaatccaagaggaccaaagaaacacaatgcatcaactttaatacagacaatatgttttgatcttgaggactaaataaatgtcaattatgtgcttacatctccatc

SEQ ID NO: 89840 - DNA, 324 bp, Homo sapiens
cctagaggatccccaaacaccgcaatctgtgtagacactaaggacaattttatttattgctacattataaagttgaaattatacattagaaagtatgtgttttattattaaaatctggttaaatgcaataaaatcacattcacttttagaaaggtataaatatctgtttggaaatgaatagtatttttaaaattggaataattgaggtttgtcttctatctgtgggcagtaattagagtttctgaactggctgaaatgatcaattatgtgtcatataccctttcaggaccttgtctattttttttctgagattgcggtgttata

SEQ ID NO: 89841 - DNA, 187 bp, Homo sapiens
ttacagaattcacttagataatttctagtctttcctctcctgcatgctgggctctgtaataagtttaggaggtcggctttctttaaattatccccaggttggaggattttgggtgttgggatgcccagggtggtggtccttcttagctttgtcttgcctaacatacttttagaattggtgtagagct

SEQ ID NO: 89842 - DNA, 402 bp, Homo sapiens
ctggagaggggcttgtacaaagtgatggaaggtgatgagaagccattgggttgtaagtctcaccggaaggtagaaccaacacagtagataagtggacagattttgtatatgtgaaagaaagaagtgtagaggctattcattaggtttgtcctgcaaactggaagaatggagtcctcactaattgaaatgaagacgactttgggaatgggagagtgggaggcaggtttgatggagaaaatgtcaggtggttttctgagatgtctattaaatattaaccagaggtgccaagccaaaggtacacatatgggcttggactatggtggagatttctgagctagaggtatacatttgggagtcatcagcacacagatgatgtctgaagctatggtagtgggtgcagtc

SEQ ID NO: 89843 - DNA, 346 bp, Homo sapiens
gggaggatatgcaaagattagatgcaaatattacagcattctgtagaagggacttgagcatttctggattttggtttcacagggagccctggaatgaatcccccacagatgcctagggacagctgtacatcctattacattttctcagaaaatgtgatggcagcttaaagctttaatccttctaaagtctgtgagaagtttgcttcttttagttcaagttgctgttaatgttgtttgtcatggcttcgctttttgtcctgtcttctaaattgtatccctcaattgatgacttgctctcttgccggtagcctctatgcactgtaaatttgccttctcaccacatcct

SEQ ID NO: 89844 - DNA, 491 bp, Homo sapiens
ctggcttcaagcgatccacctgccttggcctcccaaagtgctaggattacaggcatgagccaccacgcctggccataaatatgttaaaaggttgatatagaaacagatgaccgtggcatttagagttttggggtgttgagggagtcaggggtaactccagaaaggattgatatctgtgaattgtcctgaagggtaagaaggaatcagcaaaactcccaaattaaaaactttaccaaaaacatttcatcttagtgctaagtctactattttctacaaaatacatatttctaaatttttcatttactattttaaaattcttagcttccctcctcatccctgattaaaaaaaattttttttttgccctttggcttcttacatttttaatgaatgtgtttatgagtactttggactccactgaaaaaaattagaagaggccaagagagtaggatgaagggccttccagacagggggaatagactgaaaaaaaaaa

SEQ ID NO: 89845 - DNA, 472 bp, Homo sapiens
tatgagaatgaagacagcatttttccccttcattttcccttttccctatatttttctttcctggacttgttcataaccattatataatgcaatgcctggcacaaggtaggtgttcagtaagtactgaatggatagatggaaggagggatggatgtatattaagtgtcacttcagaccactgagtaatagctagtagctcagttttggggagggaatcatcttcagagtcttctttttcttaccttcctatttttcacttagcgcaatgtctgacccatccaaaacactcaaaaatagttgttgagtgaataagaaaatgagtgaaagagcagtcaaatcagtccaaaaaatttagatggttctgtttctgagataactctcaaatctttcctctcctttttacttctaatacactaccctggttgagaatctcaaggctattgcgtgctccttctaactagcctaacatttc

SEQ ID NO: 89846 - DNA, 361 bp, Homo sapiens
cttaatacaattttcctatctaaaaaaacataattttaaaataatctaataaccaatctatgttcagtttttgccagttgtctcaaaaatctctatagtttgtctaaatcaagatccagtaaaatagtccagtacgaactactgaaagtttgctcccttcataaaagcattgaaaaacctgccacatactatcaaaatcaactttcacagaactctggaaattagccaaaagcttgcggcaacccagaaaacttcaactgaaaaaaaaaaaagttgaattctagtagaaacagcaagctatgtggtattttaccttattaccagattttaaatcagctattttaaacatgttcaaagagcc

SEQ ID NO: 89847 - DNA, 414 bp, Homo sapiens
tgtgctcctgacatatagtgggtaaaggccaaggatgctgctaaatagcctgcaatgcacagggcacaacaaagaatgatcaagcccggaagtcaatagggccaagattgagaaaacctacatgtttgcatcatccttctgcagacctcagagatggtggcaaattcctgggattccccccacttcagttattgcagaaccactgcggtaatatttactaggttcacatatacaagaacttttatttacttaacatgtttgtgcaaattaactcaattttgaatgatttagccttcttactaatatctttgaaactgcagatttgatcttctaattatatttttcaatacacatcaaaattaaaatatgattattaatgttaaaaatgcttggctgggcatagtggctcacacc

SEQ ID NO: 89848 - DNA, 669 bp, Homo sapiens
tcaacggggtggttggccaggcagcattgttccaggtagaagccccctggccagggatgggtcctggaggatgcaggatcctaaactggcctgaggccacctcccaaccctttgaacaaatgaagaaaaagagcccctgagtgagaagaagaactgggatggatcacagggctcaggactcctggtccagtgctccctctacagcagcaccctcggggagtctgtgtgtttcaggtacagacaccaagagaccagagagttttcccctcgtggctctaccaccagaatatccagaatgagtaaacccatagaaacaaaaagcagattggtggctgccagactagggaaggacggaatggggagtaaatgcttaatgggtacagggtttccttttggagtgataatgtttgaaactagaagtggcagttgcacacatcatgaatatgtactaaatgccactgggttgttcacgtttttgtttttgtttttttttgagacggagtcttgctctgtcgccaggctggagggcagtggcgcgatcttggctcactgcaacctccaccgcctgggttcaagcgattctcctgcctcagcctcctgagtagctgggactacaggcgcgcgccacccacacccagctaattttttgtatttttagtggagacaggg

SEQ ID NO: 89849 - DNA, 336 bp, Homo sapiens
tcagaaaaaaaaggacttagttctctaaactatgtgcaaattaaaactgcagccttaaacttccttctctgaaaaatctatcggcaatatgattactaaatgcaaggattctgatttgttagttataggcttataaactgctactatattcccctgagagtcttttgcatgacaaaattcttaatacctacagacttgaaggtatggcacttaaaaaaaaaaaaaaagtttcccaggactgattacactttgaaaactgatgtgggttcacgacttccacaacaattttttcccataaactctgatacatctacttggtgccaaacaccgttaggc

SEQ ID NO: 89850 - DNA, 547 bp, Homo sapiens
acacacaacacacagacacaaaaagacacacaacacacaggaacatacaacacacacaggcacacacacaacacagacacataggcatatgaaaatacagagacacacacagacacacacacacaaacacaacacacaaagacatacacagacccactggcacatgtacacacataaggaaacacaaaatgcacagagacacacagatacataggcacacacagacacagacacatgaacacacacacaaacacactacacacacagacacagacacactggcatacagacacagagacacatagatacacagatacacaaagaacacacactcacacagacacacacaacacacaaagacccacccatactgacacactcacacaaacatacagacagcaaagggagacacactgacacacacagagacacacaaacacatgaacacacacagacataagacatatgacacacagatacactgacagagacaaacacatgaacacacacacaacatatgacacacacagacacacaaaggcagaca

SEQ ID NO: 89851 - DNA, 137 bp, Homo sapiens
agtgcagaggacttggaacagatagacagcagcttcctatagaacgcatgtggctttcttcaaggaaagccaatttccttcagacttgtgcagcaatgagaagaatgagacccaccttaaagacttccatctgtctt

SEQ ID NO: 89852 - DNA, 254 bp, Homo sapiens
taatatctttactcaaaataataacattttaacacctaaagattcttcaaaaatatgttaattctaagaataccatgttacggacaaaaatcttaaaatatagtcttcaaaaaaatactacattcaaaatctgtgaaatgttggtaaagcaattctcagaaagtaactttattgctgtaaatgattttgccgtcaaaaacaataaaaataagttactaaatattggtttagaactttcatatagaagtgaccga

SEQ ID NO: 89853 - DNA, 366 bp, Homo sapiens
ttcatatctctcccacatctgcccctgttggttgactttgcctccctatatgggtcccataaggccggcaagggagggtccacatctctcaatcctttgtccaccattggtgtttagaaccccctggaggaaaactggatcatagtgcaacatgaaaaaaaaagaactttaggccgggtgcagtggctcacgcctgtaatgccagcactttgggaggccgaggtgggcggatcacttgaggtcaggagttcgagaccagcctggccaacatggtgaaaccctgtctctactaaaaataaaaaaatgagctgagcgtggtggcatgcacctgtaatcccagctatttgggaggctgaggcaggagaa

SEQ ID NO: 89854 - DNA, 451 bp, Homo sapiens
cttttagcctacagttttctgttactaatattgcctctcttgcttcattttgcatgtctctgtgtgtgtgtctgtgtaggtgtgtatgtttgagtaatatatttggtaatacttttaactttgctttaatttttttatgtgtttctgttacaaaaactatgcaataggctgggcgtggtggctcaagcctgtaatcccagcactttgggaggctgaggtgggcagatcacctgaggtcaggagtttgagaccagcctggccaacatgatgaaacctcatctctactaaaaatataaaaattaggcaggcatggtggcaggcgcctgtaatcccagctactcaggaggctgaggcagaagaatcgcttgaacccgggaggcagaggttgcagtgagccgagatcgtgccattgcactccagcctggggaacaagagcgagacttcatctaaa

SEQ ID NO: 89855 - DNA, 1955 bp, Homo sapiens
aaaatgtacatttttgtattattttttcttattccaacctaatcggtggcttgtcccttcctgtgtttattgggctgttgggtgcctggatagagctggagaccatttaactgctgtatgaataatagataagcgtcttgaataacatctgaatttcctaggtatgtagaaacacccaccatgcacatatatgaacatacagaatatatgaatgttaaaatatggtgaaaacaatcttttgctaatagaagtgttaacctttatttttaaaaaaaatttggtgtgtatgtagaggtttatttgattgttagttgtgtccatgtataatatgtcatctacctttacagatgtgcagaaatttgttgtatttggtggatatattttacttaaaactatagggcagaagctttttatgtttgttgaagtgaaatggcataccaaacctgtgtggtagagtgggatttttagattgctgtgtgtacagtcaggttatatctttaaaatacctattcgttatatattaatatgtagacattgctgatacatatgtatgtaaaaatcagagtatttttattaatataggcattagcttcttgattcacttgtttgttgggaagcacttggagaaggatgttgaatactttgtcatttcatctctgtgacgtacagttgtcatgtcaaccctcctatctgcgggttttgcatctgcaagcacatgcagctggaaagtacagcattggcagaatctgaaacccgagtaaagagcacctcattttcataaccatgggttctgaagagctaagggagttgaggatgcaccgattttggtatgggggtacggtacaggtacaaatccccgatggatatcactagacaactgtacaatcctctttagctttttttttgttttatagacagtgtggacgtgcatatattgcaagcatcactttgttaaactatgcttaaccctgcaaatgattttaagagctctgtgtgggtggctttcttgggtttactattaaatatctgtgtttatcatagttgttctataacatttcaactttgtaaatatgtagtttgttgataaagaggatagagacatttttcttttgttgatagattgttctttcccctttgcttagtcttcattgtgttgctgggattgtaaaagacaaattacttgcacatatttaagcttatatattaaatgtatatatgctgtcatgttagagagggagagtggttccctcccccacattttgatttaaaagtaaaaattaatttttattaaattgtttgggtcagtttcatgtaagaataatctctacattgaatggtatatcttggccgggtgcggaggctcacgcctgtaatcccagcactttgggaggccgaaggggccagatcacgaggtcaggagttcgaaaccagcctggccaatatggtgaaaccccgtctctactaaaaatacaaaaactagccggccgtggtagtgcacatctgtaatcccagctactcggcagtctgaggcagaagaatagcttgaacccaggaggcagaagttgcagtgagccaagatcgcgccactgcactccagcctgggcgacagagtgagactccctctcaaaaaaaaaaaggtatatcttattttctttgatgtactgaggttcatgatgcaattcattcttaagcatatactatagaatctttaaattatatggttctgtgttcatttgtggcatgacagtaaccaagacaatttagtaaataatcagcaaatgaaatatttaattttgaacatctagtatttctagatgtatagagagtctcacgaagtagattttttaagtatcttgttgtaaatttgttagtactgttgtcttttgcaattaatgtggcaatgaaattgattattgatacacaggctcttggagctaaacaaaatttatcgtgtt

SEQ ID NO: 89856 - DNA, 436 bp, Homo sapiens
gacgaaaaatcagcaggtcttggcatatcctagatgaaattcacagcggggcagtacacgatgatggctgagtgcagaggctctggagctggggttatatttttattctaccacttagaccagtaacttgtctgttgtctgcctcacttttctcacctgtgaagtggtggcagtgatgaaaatgctgagagagctgtgagatcacacctgaacagcacttagcaatcaggcctgacactcagtgggttatttttatccctgaatttctaaacttataaactttaaatcttcatgattaaataaaggagcatggttttaaaaagacctgcttgtagtccagactatttctagggcttgccacgaagaaaacctggtggaagctcctgccggaaatctgttcagagtgtgtttccattttggacttcttcagacacca

SEQ ID NO: 89857 - DNA, 1224 bp, Homo sapiens
ggcacgagggtgagcttctgtcctaggggagctccgggggcctgtcccatcatttgccttcagccagaatgacatgtgcctggtgtttgtagcttttgccacctgggctgtgaggacgtcagatccgcataccccagacgcctggaaaacagccttgctggccaacgtcggcaccatctctgccatccgctacttccgccggcaggcggggcaagggcgccgcagccacagccccagccccagctcctaggagccaggcccgggccagggagatgcaggatgaggagacgaccacaggcgcccagggcaggacgaggtgccgccctcgcccgggccctctgacccctctcttctaccgcgtccaggaggggggcgtgtcctggtgctgctccctccgactcacctgaggatccagccagtgaccacggccactccccacgcctgggagggaggtgctaaagtctgggtgggtggagggcaggcaggtggctgggtaggagggtggccagattcacagatgagaacacagggcattcggttaatttcagacaggcaatagtggggaggtcattttactaagaagttgttgtttatctgaaatcaaatgcaaccgcaccctgcgtttcttctggggtgcagggggagctgagtggcaggacaggacttggacctcggaggggtctgagcagcaagacactccggctggagctctgggcagaggcaggggagaggacacagggtggcctcaaagaggggatgggcagcctcctcacaggtgggctgggctggcaagggctccaaggcccatcactcttgatcctcaaaggactgtggccaaggcctctgcgggctctggcctgagacagcgaaggctctgcctgcccctccccagtgcagcggcccctgcagggtgggggtctgtggcagagccgcgagcccctccccgggagccctgggtgcaggtgcagagggagaattcggtggcctcagatggagggctgggctcctggggttgtcccgggggctcctgtggggcagctggggacccacagccaagaggagtcagagatgaggtgggaaggtcggtgaggggcccgaggtggcagaggaagggggctgcctggctgggtgctgggtgggggtcctcaagactgtgggagaccctggctgctgagcagagaacacatggatgcagcaccaataaaattctatcttttctttttc

SEQ ID NO: 89858 - DNA, 114 bp, Homo sapiens
cagcaactggctagcctgcggaccccgggctcccaagagaactgctcctctctgacctctcgccaaactggtctgaaagtttctggggtcctgggagtggtgggaggtgctttt

SEQ ID NO: 89859 - DNA, 953 bp, Homo sapiens
aattaaatgagttagtatacacaaatgcctagagcagtgcctgcgtccagtttaatttggctttacaaatttaaacctgcaaggattatgtaattagacatacataaattttacacaaataaaaatcagagtgaatgtaatttgacatcagttgaataaaatgaagcaaaatatcataatctttggtttattactgtgtatttggtaatcctggaaattgatacaatttgcattttagtttaagtgcatgttatttaagtaacatttaagttttataagatcatggaattaaccattttttcgtatttttcaattagaaaaattttgtatttttacaattagaaaagtgtaattttttattagtatgcaacagatatgacacagctaggctaaatcaaattattacatatagtccaaaatttagatgattatactgaatattagtattcacttactgtactactgaagagtcaacatttcaaagctaatgatgaaaattatctactaagtgtgtgactttttccccaagaatgatttcatctgcttccaccaatttcagtattctagttgatagagtcaaaatcatagcatgcggaagcagcacaagatatcatgtgcaacatgtgttgtgccaagtcagtaaacagccatcgtaggagtggccagcgtggccttataccttactagaacccagagaaaaaagagcctgctttttaaagagaaaggcaaaattgcttctggcctccatttcccactctttgtttctcatgggaagaagcaagaattccagaatcgtgtgaaattttcatggttttatgaaatcattctctgagtcattaaaatgtatgctaagaaaaaaaatctaacttatgctttatgctcagatgcaattttaatagtctcaaactaagataaacaaatatcccagcacacttttttaattaaaaaaaaaa

SEQ ID NO: 89860 - DNA, 410 bp, Homo sapiens
taccatcttaactatctttaagtgtgcaattcaatcgtgttaagcacattttcaatacggacagcaattgccaccatccatctctagaactcttcatcttacccaacaggaactccatacccactaaacaccaactccccagctcttggcaaccaccattctttctgtctctatgactccggctacaccaggtatttcatacaagtgggatctcatgcagtatttgttcttttgtgactagtttatttcactcagcatgatgtcttcaaggttcattcatgttgtagcatgtgtcagaatttccttccttttcccccctgaataatattcctttgtgtgaatacatcccactttgttgatctgttcatccatcagtagacacctgggtcacttccatctttaggccttag

SEQ ID NO: 89861 - DNA, 484 bp, Homo sapiens
atacagaacacagatgcctgcccacacctactgtgtgctgtagggaagaaaacagctttcccttctacccatctgaaattcattggctggggccctgtaacaaaagacagattaacgagagaaaagcatatacatttgatatggtttggatctgtgttcccacccaaatctcattcagttgcaatccccagtgttggaggtggggtctggtaggaggtcattggatcacaggggtgtttctcaaggtttaataccactcccttggagctgttgggatagtgagttttgtgatctggttgtttaaaagagtatggtacctccacctctctccttgcttctgcaccaccatgtaagatgccttgcttcccatttgccttccgccatgagtaaaatctccctgaggtctccccagaagcagaagctgctatgcttcctgtacagcctgtggttttatgagccaattaaacctcttctctttataatt

SEQ ID NO: 89862 - DNA, 175 bp, Homo sapiens
cggagctaatgcacccggctcctctccatggctctccgcgggtgtagacccagacccctgcccgggctgtggagtccaagctgggttctgctggaacatcctagtctctagcttgttccccaagttagcagtcatttgtcttcttctttctttctttttttgagtcttgctctgt

SEQ ID NO: 89863 - DNA, 1739 bp, Homo sapiens
ggcggggccagggccagactggtctgggccccagtcgagggctgcaggtggtaggctgcgaccccttcctcccacagccccttcccgcccctcgccgggcatccgccgacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccaccctcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaac

SEQ ID NO: 89864 - DNA, 401 bp, Homo sapiens
  misc_feature (47)..(47): n is a, c, g, or t
tagccacgcgacaacgcagtcgtcgcagaaaatgtggaggatgatgngttgcacctccgccttgttaacgaggtacacgaggttgacgacaccatccagaccctgcagcagcgcctgagggatgcagaggacaccctgcagtcgctggtccacatcaaagccaccctcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaac

SEQ ID NO: 89865 - DNA, 1773 bp, Homo sapiens
ggcggggccagggccagactggtctgggccccagtcgagggctgcaggtggtaggctgcgaccccttcctcccacagccccttcccgcccctcgccgggcatccgccgacaggtacataccaagaaattgaattgctgagtcacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccaccctcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaac

SEQ ID NO: 89866 - DNA, 1061 bp, Homo sapiens
ggcggggccagggccagactggtctgggccccagtcgagggctgcaggtggtaggctgcgaccccttcctcccacagccccttcccgcccctcgccgggcatccgccgacaggtacataccaagaaattgaattgctgagtcacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggtaaatgtgggggaaatgcatcagtcacaggcagcttagttgtaaatgtatgttgaatatgtagaagcaaaaaaggatgttacataaaatgacttataagtaaagcattatcgtatcagatgctgatagcatttagcaaagacatgtttttcttggttataacatatattcaatgagaatatgaaaatgcaaacgagtaaataaagatgaaaatcacttgaaa

SEQ ID NO: 89867 - DNA, 495 bp, Homo sapiens
tcactcaggctgcatgtttttcaaagtgggttccatagaacccctcttcatgcacagctcattatttaggataagcagctctccactccagagactacatgggcccctagacagccaactggaggcacctctctgctttagaagaacccagcaccttgttaacgaggtacacgaggttgacgacaccatccagaccctgcagcagcgcctgagggatgcagaggacaccctgcagtcgctggtccacatcaaagccaccctcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaac

SEQ ID NO: 89868 - DNA, 1522 bp, Homo sapiens
ggcggggccagggccagactggtctgggccccagtcgagggctgcaggtggtaggctgcgaccccttcctcccacagccccttcccgcccctcgccgggcatccgccgacaggtacataccaagaaattgaattgctgagtcacaggagagatttacaaatagtgttttggcatcatggaacgtaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccaccctcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaac

SEQ ID NO: 89869 - DNA, 322 bp, Homo sapiens
ccaggctggtctcaaactcctgacctcgtgatccacccgcctcggcctcccaaagtgctgggattacaggcgtgagccattgtgcatggcctcatctggactttttaaaactgtttgtaccctaatccatatctccagtccagatcttccccctgggcctcggcccctcacaccagataaaccagctatctccacttacatgtttctcacattcctagaacttggtatgccccaaactgtatcatcatcttcacccctgccccctttctagcagcccattccccttgtagagttcatgtctccacaaaaaccaccatttacc

SEQ ID NO: 89870 - DNA, 301 bp, Homo sapiens
ctcccgggttcaagcgattctcctgcctcggcctcccgagtagctgagattacaggcacctgccaccacgcctggctaattttttgtatttttagtagaaacggggtttcaccatgttagccaggctggtctcgaactcctgacctcaggagatctgcccacctcggtcgcccaaattgctgggattacaagcgtgagccaccgcgcccggacccgtggatttgttttaacaggtgtggtaaggcatgcacacgtgagaatgactgttgtgaaggaagaagttatagtcgtgggtccctgg

SEQ ID NO: 89871 - DNA, 3575 bp, Homo sapiens
  misc_feature (2505)..(2505): n is a, c, g, or t
  misc_feature (2809)..(2809): n is a, c, g, or t
  misc_feature (3075)..(3075): n is a, c, g, or t
gctgtcagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagggccagccgcgggactgacaccctgggatggaacctcaggatgggccaaacccagacaacgggcccatggccttgggctctgattggctggattgccttgtatgcaaatgagttcaggactacaataccctaccctatggggaggccctgcctccgggaggtcattttttaaatccagccccttgcttcaaccgtccccagtattagacgctgcagcccngacggctccccccaaataaggctgggtttttctctctctcttttttttttttttttttttttgagacagggtcatgctctgtcacccaggctggagtgcagtggtgtgatctcggctcactgcaacctctgcctcccaggctcaagtgattctcctgcctcagcctcttgagtagctgggattgtaggtgcccaccaccatgcccagccaactttttgtatttttagtagagacagggtttcaccatgttggtcaggctggtctcgaactcctgacctcaagtgatccacctgcctcggcctcncaaagtgctgggttacaggcgtaagctaccatgcccagcctaccgtttttctcaatctataatagaaagccaccacgcccaggtaatttttgtaattttgtatttttgtagagacggggttttgccatgttggccaggctggtctcaaactcctgatctcaggtgatcctcctgccttggcctcccaaagggctgggattacaggggtgagccaccgcgccccacctctttcttattttcttcctgggattggggaggggatgatncagaccccacatggcctccaaccttggcccacacacctgccatggctcccatcatcctgagcatgctagcgtcccctcctcacctgacaatggaggctctcgaattgggttgtgtccccccaaaatttatgtctacccagaacctcagaacatgagcttacttggaaatagggtctttgcaggtgtaactggttaaattaaaagaggtattactggaggaggatggatgaatccagtgactggttcctcatatgaagtagagaagagatgcagagaaacacatggggaagatgccacgtgaagacagaggcagtggttggatcaatgcatctacgagtcggagaacccaaggattgccagcaacaaccagaaatcaggaggggggcatgagatgcattatttcttagagcctttagagggaacatggccctactgacaccttgatgtcagacttctggctgctagaactgtcagagaataaatttctgttgtttgatgcc

SEQ ID NO: 89872 - DNA, 260 bp, Homo sapiens
tgcattcctttcagtgatattgacatactcataattctccagcgttaaaaatcttggtttttatggtggggtttctccttttttgtttcctcattatgtaattgatttttcgttaattctgcctttataatataaaattcttattaatttaaacatagcttacattcttcccttaatgattccttatttattattatattaggtctaagtacttcagaccagagttaaggccttctctcaagaggataatcccctctact

SEQ ID NO: 89873 - DNA, 102 bp, Homo sapiens
taggcaagccttaggctttgagctatgcagagctgacttccatgtcaaacatctgagagcaggagccttgctctcatttcttcggtgcctcctcccagtctg

SEQ ID NO: 89874 - DNA, 772 bp, Homo sapiens
tcgacctcccaggctcaacccatcctcccacctcagcccccagagtagctgggactacaggcgcaagtcaccatgccaagataatttgtagagaaggggttttgccatgttgcccaggctggttttgaacttctgggctcaagcagtctgcctgccttggcatcccaaagtgttgggattacaggcatgagccatcgcacctggtcccattgtttccataatgtgccaaaattgtgtactactctaaaagcatatctgctatctttttaaatatttactgacgtgtccttaactatatgacaagcttgggtgggagcaaaaagctctgccagctgagcggacttaaattgaggaagagttcccttctctattaactcattttgggcagtaacaacataccctgcctgatattttccttctgagactttggcataggacccacgaacaaaaagtatcaactcaggattatccaatggagcatctcataaatcaacacaaggggctactagtttggatactacacctacacaattgtgatctttaccacagtcagtcagaggtaatggagtagcagggttaagtaggttttagatggagtagcattttagatggaggtcagaaggaggcaggagaaaatttcataagatcataagatgttagttttcttgctgaaaaatgctgagcttggttggaatttaatagactttccacagcatgtggaatttgcaaattaagttcattccctaaaaccagctcagatgaaacttgtagc

SEQ ID NO: 89875 - DNA, 230 bp, Homo sapiens
tattacattattccatctttttctgctgtgtattgtaagaactttggtttttaaggatttgccctctgctgcaaatatatagcttatcaaagaaggggagaaataatgttttggagtttaattgtaaatgctaatttctgtgaggagtcctttaggaggtttcactaaagttactaaaaccatgctgtcatgatattttgtagttataatgatcatgagcaataaacagt

SEQ ID NO: 89876 - DNA, 835 bp, Homo sapiens
ccagaaactagctgagcatctcacgcattccagacaggaaaacaatgtatgaacaatgggagaatttcaacaaagagacagaaaatgctaaaaagtaccaaacagaaatcatggagctgaagaatatgataactgcactgaaaaagtcactagatgaggggaacagtagactggatcaagcagaaaaaaggatcagtgaactcaaagaaaggtcattggaaattaatcataggagcaaacggaaaaaaagaaaaagagtaaagaaagtagaagggacttatgggacaccatcaatcagaccaatagatgcattaagggagtcccagaaagataagggaaagaatcattatattcaaagaaataacggttgaaaactcctcagatctgtggaagaaaatggacacccagattcaagaagcccaaaagatcccaaataagatgaactcaaagacatttacagcaagggacattaaaatcaagttgtcaaagacaaagaattagaaagcagcagggaaaagtgacttgtcacatttaaaagaatctccataagaaataagctaatttttcagaaatcttgcaaaccagagggaatgggatgacatactcaaagtgctgacatttttaaaactaccaagcaagaatactgtgcctgggaaagaactgtctttcagaaatgaagatgagcgacatactttccagacaaacaaaagctgacactgttcttcactatgaacttgccttgtaagaaataatgaagggagttatttcactggaaatgaaaggacaataaacagcaacatgatagcataagaaaacataaaactctttttattta

SEQ ID NO: 89877 - DNA, 444 bp, Homo sapiens
ttttctcctgatgatggactcagcattactattgcacaggcgaaaacaaagacagaatctaagcaacttccacctatcacacattaggccactgaactgagtatttcccattcctgactcaaagttaaccttttcaaaaattatgatatggtttatatttagaaactaatttaagatgaatccaatgttactttccttttatatcaagtaaaataatgaatttcaaagccacatacacacacatatgtgtgtctgtgtattttggcgtttctaaaaatgacattgacttaactagatcattgatataattaaatccgatatttccttgatgaccatgagaatcatcaaagaaaaataataaagtaccactaatctcaaaaattaatatagtaaaaagagtaaacagaataaatgaagaattaggacacccaggtaatagcacca

SEQ ID NO: 89878 - DNA, 240 bp, Homo sapiens
tccagcaaacattcagtaagcattcaatgaagtgctgggtattctgtgtggtacttcggtttcagagttgaagagacagtgcctttccttaaggaattcccagtctagtgggacaacagacaaggagatagatactatctgtctgtctattatttatgtgataaatgctgggctagatatattttcagagtgctgtagggccacagagaagggatgacgaatattatcttggggggagtc

SEQ ID NO: 89879 - DNA, 414 bp, Homo sapiens
gccctgtgctgctgggtttctggttgaggcaagggtgtgtcttgtggttcagtgatgtgtcacctctgtacctctcatcttcgggctccatctcaatactgagcaagatatagagtgtagacacatggaagacaatgagaaaattttctacagccctagacattcgacagctctctccctctctctctctctgtttcttgctccctgtctgtatctctctctctttctctctttgtctttatcgctctacctctgtctgtcctctgtctatattgctctatctctgtcttccctctctctgtctcttgctctgtctctatctttctgtctctcaccaggacctgtgctactggtcagtgtgccctgttttgccatggggacagacccaagggacctcctctgcatggttcttgc

SEQ ID NO: 89880 - DNA, 437 bp, Homo sapiens
tcgctgtcacatggtgctcttcccatgtgtccgtcttcacactgccatctcctgatacggacaccagtcataatgggcccaccctcctccaagatgacctcaccttgactgatcacatctgcaatgaccccagttccaaataagatcacattctgaggtaaaggtggttaggacttcaacgtatcctttttgcgggggacacgattcaacccctaacagtaacctatctttttttttaagagatggggtgttcttgaagtcctgggctcaagcaatcctcccttcttggtctcccaaagtgctgggattacaggcctgagctaccacacccagcctattgttgcctgttttaatgcagctgaggaaactgagtctcagaagggttatgctttgccccagagcacacagctaggaagggacagtctgagatttgaacc

SEQ ID NO: 89881 - DNA, 182 bp, Homo sapiens
tggatgctgtcagttcttcctcctcctgccatagcagaggagtgtgagtccccgccccactgatgttcacgcgacttactgtggcatggagcgggcctgaatcccagccctctgcctgaagcaaagcctcccagctgagcccagcctagtcagccgaaccctagccaagctgcagacgagag

SEQ ID NO: 89882 - DNA, 410 bp, Homo sapiens
gcttcaacctcctgggctcaagcgatcctctcacctcagcctcccaagtagatggaactacaggcacatgccactaacttttttcttattttttgtagaggcagggtcttaccatgtagcccaagctagtcttcctaatttctaaccagccaagctatgctcagtatgttcctttaaggaagtgatctgaagtttaagtaagttaagtttttcttgaaaacccatggaaattgggcactgtggctcacgcctgtaatctcagcactctgggaggcagaggcaggcgaatcacaaggtcaagagatcaagaccatcctagccaagatggtgaaatcccatctctactaaaaatacaaaactagctgggcatggtggcccacacttgtagtcccagctactcgggaggctga

SEQ ID NO: 89883 - DNA, 642 bp, Homo sapiens
gaagtcccacaattcccatgtgtcatgggaggaacctggtgggaggtgattaaattatggggcagatctttcccacgctgttttcctgatagtgaattaatcttatgagatctgatggttttaaacaagggagtttctctacacaagctctctctttgcctgctgccatccatgtaagagtgacttgctcctgcttgccttccaccgtgattgtgaggcttccccagccacatggaactgttaaatccattaaacctctttcttttgtaaattgcccactcttggatatgtgtttatcagtagcgtgaaaatggactaatacgtacacctacctaaatggaaaacgacaccaatgtcgaattttacctattctttgaaaaaaaaattttttcctttcagccatcaaacattttaaagtatttaaggggagaagagtttattatatttacccaggtatttatcatttcttttgatttctcttcatttttgaagtcccacctttccctctggtagtttctcttatgcctggagaacttcctttaacatttcttttagagcacgtctgctggctacagattttagtttagtttagttttcctgcatctgagaatgtctttatgaccttaattcctaaaagatatt

SEQ ID NO: 89884 - DNA, 211 bp, Homo sapiens
atcttgtgttttcattttcatttgttttgagaaatttctattttttaaaagaattttgttatttacccactgatcattcaggagcaatgtatttaatttcggtgtatttgtacagtttcttaagtgctcttcttactgatttctagtgttgtttcattgtggtcagaaaagacacttgatattaatttgactttttaaaatttgttgagat

SEQ ID NO: 89885 - DNA, 584 bp, Homo sapiens
gggccttggaggttcctacttattttaatcagttccatagcctgaccctggtccagtgagcatcagatttggagactgtgccatttatgaaacaggcaggtattggagagactccaaaaagcttgtctcatgtgtgcttccctgcaaaaacagccagttccagctagaaactttatcttcatgaaaggaaacctctaggcagagagaagttctatttgtttttacaactgtccccagttgtatttgaagatggcaaaatgttgggcttaaggcctgccctgggttcatggagctagctttcttaatgcctcaatcatacttttaatcagaaaaaatttagagcattaatcttcagtgcttgttcttgccatttccagccactcgacactttttcataaacaaagtgacagtttgattgaatgtggtttttaattaagctgccttcacttggaacaactttctgggggcatatgtaaggagcagaacttagaagcacaagctgagactgacttcgcaatagcttcatctccaggcagagtttgagaacaaaggaaaccaggcaagtggaattaaccaggcacctt

SEQ ID NO: 89886 - DNA, 386 bp, Homo sapiens
tatctagcaggatctcatccccggttctgggtacctggaaaagcatgggtaaagtctctctggctggagggtggcgagtcaggagaaggaagcagcacacgatgaggctaatgggacaggaggggccagactgtgcaagggataggaggcatgttggggattctgggctttatattgagccgctgctatttccagcagggagggctgtgatcaggtttgggttgtgtggagaatagcggaggaatacacagaggggaggcccagtttttcctgtgggagccttggaaggtgagaaaagagtggctggtcatttccaactctaagccctggtgttcctttcatactaccccaggagtgttcttttcttatcctttcttttccctccc

SEQ ID NO: 89887 - DNA, 381 bp, Homo sapiens
gctgatgccttcaccttggacttcccagcctccagaactgtgaggaatgaattcctattgtttacaagcctcccactttatggtatttggttatagcaacccaagcagacaaagacagccagagaactaaggacacttacatctggacatattgagtctgggctaaagatgggaagtcaggaatcaggtcagtctgacactgcccataggcctaatagtgatgtactcagaggttggaactaagccctcaaaggaaatgagtctgtcttgtttaagttagacaagtctgtcttgttcagtagtttatattccctactacaatgaagttagtatgcagtatagctaattctacttgagatatgtatgtcggtgtgagtaaat

SEQ ID NO: 89888 - DNA, 711 bp, Homo sapiens
atttactatcagaataattggtaattattctgtcactctaaaactcagtaattcctaaggatattgtgaaataccttgtgtagctagataagttactaaaatattataatcctatcagaagctgaatggggtgttattttctaaaagccatctatagaacacaagtaagaattcagtaacttctgaaagatcaaaaagctgctttattttagttctcaagtttggtataatgaaatatattaggaattcaattccagaatatttatggcaccacacataagacagaaatgacaaaaagacactgtagaaaaactggagcatctctccaaaaataccaaatttggggaggtaaatgattacaggattgataatgtccagaattcactgtagaggatgataaaagactgaatcaattttaattgtaatgtgtaaaaatgttaaactggcggggtgtggtggctcacgcctgtaatcccagcactttggaagcctgaggtgggcagattacttgaggtcaggagttcgagaccagctcatcggcgttcccgaagaagtcatccgcccgtccctcatctgcgtctggaaggaatcatcgcccgttcctcatctgcgtccggaaggaatcatccgcccgtccctcatctgcgtcccgaagaagtcatccgcccgtcctcatctgcgtccgaagaagtcatccgccgtcctcatctc

SEQ ID NO: 89889 - DNA, 275 bp, Homo sapiens
  misc_feature (1)..(1): n is a, c, g, or t
  misc_feature (120)..(121): n is a, c, g, or t
  misc_feature (124)..(125): n is a, c, g, or t
  misc_feature (129)..(129): n is a, c, g, or t
nggcaactcagattgcactgaatagcagagtatttagaaatgaagggagctgggtcctcaggatgtgtagcagcatacattgtggaaaggtgaaaaggttacatgtaaaaacaataaccnnaanncaanccttcccatagcttcagcaggctccaggtgccgcagccctgactcctcagggcccacccctgctgtgtccacacaaatgcccccaggaagctgacacttccccgcagcctgttcctgcagtccctgccttggttcttagctggctt

SEQ ID NO: 89890 - DNA, 435 bp, Homo sapiens
tgggagcatgtgggctgcagcctcaacaaagatcttctggtgttttctctcccttgctcgcaccccaagtatttttatgctgttgacatcagttaaaagtaagcaccgacggccgcctcactgtgagtcatggagaagcagcacagagcaggtcttggtggatgccggtgactggagagagtgtagagggtgaagggaagatggcgctaccattgcctgtgctgaggggaggcctgaggtctttatgcatttgtgtgtttactctcttgtggctttcttgtgagctccagggaaatcatgctggcttggtatccctcagcaactcagagctgaggtgtgttcagccacatcttccttccaagcatgttcctcccaggacttggttttgaattcatgtttcacgagctttgtgactgtaacttatagaactttcat

SEQ ID NO: 89891 - DNA, 465 bp, Homo sapiens
ctgagaacagtgcctggcacataataagtgctaggtaaatatgagctattattgccattattacttaactgaccttgtacagagcccagaagagcacttggtgattgtgctcaactaatcaattataacattgcccacttctggagaggaggagatcttgtactctctcccacccttgcctgattccagcccctcagatcaaacgtatccttcttactccttgtctagtgccatcttctcgagtcttttttctttttcttgtttccttcctttctccctcccttcacaacttttgtgaaagcatttcattccctcctttcctcattcttaaaaatcaatcttggctcaactgcagtgttctctccatggaaatcaggtcccaggaaggaattgtctccaaaagggtgtcccttgagcgtcctcagcctgggctgctggatcaggattggatgtgcatttgtgtct

SEQ ID NO: 89892 - DNA, 182 bp, Homo sapiens
acacaatgtatgattccataactataaagttcaaaaacaggcaaaactaatcgatggtgttagaagttaggttagagatgacctttggaagggatggtgagcaaaaggggttaatgttctgttcctcattcctctgataattatatgggtatgtttactttataaaaaattcaccaaaaaat

SEQ ID NO: 89893 - DNA, 584 bp, Homo sapiens
cgaacaaacaaaaaaaacaaaagtgagccaaccctggggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagtttttttctataaataacgtgaaaccgtgcttggtttctcttttccaaagtttgccttttccattacatgggcaagtcctgaacctaagccgagacactagtccatcatctccagcaatgaatgtcatccaccccagacttcagc

SEQ ID NO: 89894 - DNA, 274 bp, Homo sapiens
ctcgcatggctgcgacaaataactagaaacttggtggctttaaacgacacaacttattctgtacagttctataggttagatgtctggcacaggtctcactgggctaacatcaaggtgtcagcagggctgtattccttcctggaggctccaggggagaatccatttccttgccttttccagcttctagaggaagtcacattcccaggctcttggaccccctctccatcttcaaagccatcaccagtctgtctgcccaccctgacagataagctcc

SEQ ID NO: 89895 - DNA, 779 bp, Homo sapiens
  misc_feature (733)..(733): n is a, c, g, or t
gctaatttttgtgtttttagtagagatggggtttcaccatgttggccaggctggtctcgaattcctgacctcaggctatccgcccacctcggcctcccaaagtactgggattacaggtgtgagccacctccccgggcctagagaatgttaattgtcccactttcctatttgggtggagcatcaggccgtccatggaggagaatggtaggaaataagactgagagggtggggcctccaatatcaggccaagtatttggaatggggtcggaacatcagctctgactattgagatgagaagcaggaagaccccagaggacctcctcagattcagccaggcctgaggcagtggggcctgaggcagggtagagcagtaggaatggaaggaagagatgcataggacagggaagaatttggcagctttgtagtaactgtccctatttataaaataaaaatttttaaaaaggaaaaaaaaataagatgccagaagcatttatgagtctaaagcagaagaacttctagtgacctcagtgagaatgaccaactgttttaagtattcagggtttgcaagctattctctgctactagaggccatgtttcacagaacccagcagtggaaactgttgcatgtgaaaagcgaaggagtacgaggcatgggtgttgcatgtggaaaacaaaggaggatgaggcaaggatgacaggtttcaagcctgggatgacaaggagcatagggatnccagttcagggagctcacaggtctggtagttgttggttgtagggag

SEQ ID NO: 89896 - DNA, 890 bp, Homo sapiens
  misc_feature (113)..(113): n is a, c, g, or t
  misc_feature (844)..(844): n is a, c, g, or t
gtgaggggattttgttttttctttctgtgaggccagtgttgttttatgcccccatttgggtggctaatttcaaaaaaacttttttttttaccccttgggttttttttagtcantaaatgatcattatgctttttgtgcaaccaccaagtctaggatcatctactgagtctgtgaattgtagaatagagagaggtggttctcggcctcccaaagtactgggattacaggtgtgagccacctccccgggcctagagaatgttaattgtcccactttcctatttgggtggagcatcaggccgtccatggaggagaatggtaggaaataagactgagagggtggggcctccaatatcaggccaagtatttggaatggggtcggaacatcagctctgactattgagatgagaagcaggaagaccccagaggacctcctcagattcagccaggcctgaggcagtggggcctgaggcagggtagagcagtaggaatggaaggaagagatgcataggacagggaagaatttggcagctttgtagtaactgtccctatttataaaataaaaatttttaaaaaggaaaaaaaaataagatgccagaagcatttatgagtctaaagcagaagaacttctagtgacctcagtgagaatgaccaactgttttaagtattcagggtttgcaagctattctctgctactagaggccatgtttcacagaacccagcagtggaaactgttgcatgtgaaaagcgaaggagtacgaggcatgggtgttgcatgtggaaaacaaaggaggatgaggcaaggatgacaggtttcaagcctgggatgacaaggagcatagggatnccagttcagggagctcacaggtctggtagttgttggttgtagggag

SEQ ID NO: 89897 - DNA, 796 bp, Homo sapiens
tttatgttttgaaaaaagaagatgaagaagaagaaaaaaaaaagaacaaggaaagattaaacgttagcttgtaaagtttaaaggacctttccttttcctttacggatttgatcagtatgaagtcataaatcaaagaaaacagaattggatttgcattcccaggcgggatggatgctgccaggagatcacattgcaaatagtgaaaacagaggcattcggtctatgcctgagtcctgtgtataggatcaatcttcctttaattccgcagtctcctcaggcaatgtgacacgggatgcagtttgcagctttagtgcctttcttcgccttttaaattgccacgaatcacagatggctatttagtggccctacaatgctgcaacacatcagcttgcattttagtcttaattatttgtttcttggataatgggcagagttttctgtatttgtatcagctgttagtggtgaaatagggctctagttaaccttttatttatgaagtctaatttagtgttcccgtggctagttgcaagcattttacagtgatcacccagtttaatcttttgtatactttttagaaatgccaagagccttactaaactgaagcagatttatgatatagtgataatttaggtagatgttagtcttgaagctcttattttgtgtgcaactgattataaaaacaccttaaccaagtattattacacacatgatatctataactaggactttgataactgttatataaagtgtgtaaaatttgtatgaataaatttttgtaaacaatgcaaaaaaaaaa

SEQ ID NO: 89898 - DNA, 491 bp, Homo sapiens
tggtgttgtgtctaagaactcttcacctagcccaaagattttctcatatgttattttctaaaggttttatagttttatgctttatatttaaatctatgatccattttccacttaagagttcatttttgtacaaagtgtaaggtttagatcaagatttttttttttttttggtccgacttctggacgaggcggcggggtcggcggctatgctcggagcttcggaaggccggcctagggacgacaagaagaagaaggacgcgggaaattcggccaggaaagacaaagacccagtgaacaattcggggggcagggccaaaaagaagagggggtccacgggcaaggtccgggacaagctcaataactaagtctggtgggacaaggctacctatgataaattctgtagggaagtccccaattataaatttataacccaagttgtggtctcggagagacagggtagagccgagagacagggtagagccgagggggat

SEQ ID NO: 89899 - DNA, 419 bp, Homo sapiens
ccgggttcataccattctcctgcctcagcctcccgagtagctgggactacaggcgcccactaccacgcccggctaattttttgtatttttagtagagacggggtttcactgttttagccaggatggtctcgatctcctgacctcgtgatccgcccacctcggcctcccaaagtgctgggattacaggggtgagccaccgcgcccggcagattctgtgtttctatacagagctgatgattgcgcatgtacttaaaatgtgttcatagttcaagagttagaattagaatagagatactcactaatagagttgtgtttacctcttccatagatattaatacttgacatttgtgtgaaatatgaaatttgaacacctttctgccttaactatgaattgacatttttttgagtttccagttgtg

SEQ ID NO: 89900 - DNA, 337 bp, Homo sapiens
gttttttgtgtgtgaggagaatgtttttctagggattacaatatgatatttggcctcttacaacctacttcaagttaatgttgctttttttttcttggaaaaaatatagaaattttgcactagcatagctccattccctacccctctcgaccctcctgtactcctttgtcctttgtggtcacatatatttgtcataaattcaacaatacagtgttatatttgcttttgaaagtcttttaacaaaattagaagaaaagagaaaaaagtgtttacattcaatttacctactgtgttagtccattttctgctgttataacagactgggaaatttacaatg

SEQ ID NO: 89901 - DNA, 331 bp, Homo sapiens
aacacacactagggcctgtgcgggggtgggaagagcatcaggataaacagctaatgtatgcagggcttaatacctaggtgatgagttaataggtacagcaaaccaccatggcacacatttatgtaacacgcctgcacatcctgcatgtgtatccaggaacttaaaattaaattaaattctaaaaaaaatacaaaaattatctgggcgtggtggcaggtgcctgtaatcttgcctcctcaggaggctgaggcacaagaaccatttaaacctgggaggtggagactacagtgagctgagctcacaccactgcacttcaaccttaacaacagag

SEQ ID NO: 89902 - DNA, 297 bp, Homo sapiens
tgctgggattacaggtgtgagccactgcgcctggtctttttctagttctttatgtcaaattactgtgtcccttgaaataattccactctgtagttaagccactaactggatacttgatacacaggttctttttttttccattttgctttcaaattttacagattttttaaaatttaaattttgttttatactttaaaaaaatatttactaggttccaaaatcaagtctacaaaataaaggtatattcagggaggtctagctttcacctctgacccctctacctgcacgccacacatg

SEQ ID NO: 89903 - DNA, 432 bp, Homo sapiens
ccttggggccttcggttttaggcgggaaaggtcactggtaaggcagccccttgtttatggagcccggataccaatgacgtggtcacctccgagaagcacaattacccaacaggggcacgcccaaactcttttattggttacctcttaaacactccagaaatctgtccaagtccttgcagaatagcagaaaacaaaagtgctctcagcaggagggggaagccaggactcgatgatgagcaattagtgaatcaatgactctcagagacactgatttagaccagcagttcttattagcgaccgtcgaggaaaatgcagggacacacaaagcttccaggagagactaaagctttaaaaacatttttttaaaaatcaccacaaactgccttcagagcttccccctaaaacacttaaaatgtgtgctcagtctgagga

SEQ ID NO: 89904 - DNA, 423 bp, Homo sapiens
ttggaggtgctggaaccttttggagaagacctcggggatgtggtctctacttcatatatctgtcacagtgcaaagggcatagacagggtctatgtggccacaaggcatagagctggacccatggatggatattttaaaaaggcagattttcattcaatagaaggaagacattttctaacaattagaactatccaaagtggaacagactgcctagaaaggcatgaggtctctgtcactggagatatacaaatagaagctagacaatccctaggctgtcatattgtagaagggccccttccttgggggagggtgattggactaaattgctgttaaggctccttccaaccctaagattctaggatgctgtatattacaatgagaaaatagaaaaagaaagaatatggtgagagtgcaggggttggc

SEQ ID NO: 89905 - DNA, 452 bp, Homo sapiens
tatgattcccttgtgtttactagtaatatttagtataaaagtccatcctagggagggcctgccataccagagatgtattaatgaatccatcttacggaggacaaaactaaggctgagtggttcgtaatactgggatttgactcaaccttgtcacaacaccaaagccagtgctcttccctccaccatgctgcctcaggttacaagacacactaacaccatcgtgtagggagagatgagcttccagggctctgacatatattagacactgatgaagagattccaaagtgagctgaaactaaagatgacagcgttagggtttctagaactctcttcccacttctcaagctcgcccttaactgtatatcccatgatgttgtatttttactttaaaagaggcaattcaggccaggcacggtggctcatgcttgtaatcccagcactttgggaggccg

SEQ ID NO: 89906 - DNA, 273 bp, Homo sapiens
gcaagtttaatctgataatttatttgtggggaaaaagctagttttgatgagataaacttcagtcctttccttgtaaatacaaagaaactcaacaggaattttaaaggtagtaggccagaaaatgcaacagtaactcttataatccttttcaattaaacagacaaatcaagttgtagacaactgttaaaatattattcagccttaatatttatcagtctatatatcctgttgttcaattggcttttgattaaaaaaaacccaacacagtttata

SEQ ID NO: 89907 - DNA, 864 bp, Homo sapiens
ccctgcacaggcttcctccctcttcagctcagcttcattgctgcctctgcatccaccaggctggagtgcagtggtgtgacctcagctcactgcaacctccacctcctgggttcaagcgattctcctgcctcagcatcctgagtacaggcactacaggcacgtgagcaagagaagctgacagattcaaatgttcacaaacatttatgttctattttgatagatacataaactatgtttctcattcttatatactttatattagggcatgggattaaagtcaaaatagtggaaaattagtagaaataacatattttatatccaattaagtctccaaaatcccaacatgcactcttctgtatacgtttttcagtatgcttgactggaacggccaattctaagtagtcttggaagcaacatactgcagattaaataccttagtagcctatgttcttgaatgcggacataaaggagcaatgcttttcctatcttaaaaacagtttatatgaatgaaacttctgttctgtttaagatattatatgttgttgagtgtagttgtcaaagcaactagcacgattccaagtaatatagaaatcaccagcttgagttgggtctgccataacagcacctaaaacgtatccactaaattagtattaaatggacaagtaaaccaaactcagagggttgaaatgaagacttgtaatacccagtgaaaaaaaattattgaaactaccatctaaaattaattggaagcttaatattacctctaggaaagagtgtgggaaatgaggaaaggcaaaaggtaatgtgttcatgtttgttctgttccataatccaagaaatagataaacacaggcaaaaaaaaaa

SEQ ID NO: 89908 - DNA, 548 bp, Homo sapiens
ggaggaatgggctgagtgtcagagctggtttggtaggtaagggaggttggggaacatcgtgagcaaaggcaatgcctaagaagattatgtgtaaggggaagaatttcaatacttctagtgcatatagtttaggccagagaacaaaaagaaacagggccagaggtgtgcaaagccagatctaggtcacagccagccaagaatgccattctcagaaatgtggactctttcctaaatgttgtaagccaggaaacaatattagtgtcttcaaagtgctcttctaggggtagctgtgtaatggactagaggaagatataatagtagccccaaaaaaaaccaggtagtaggctaatactttaatccagaagatttgggaacacaaattagggccatgatggtagaaatggagagcaggtagatttgggtaggatcagtatgtcctggaatttgactgaatgtgggtgtgagaaagggctagcagcttcacatgactctcaggcttctgtgtgactaaatggagaacaatatcagaagggttacgtactagagaa

SEQ ID NO: 89909 - DNA, 921 bp, Homo sapiens
gggagactgtctctcccaaaaaattagctagatgtggtgacatgctcccagctactcaagaggcggaggtgggaaggatggcttgagcccaggatgtggaagttacggtgagctgcgactgcaccactatactccagcctggacaacagagccagaccctgtcttaaaaaaaagaaagaaagaaaaagacattattggggatccataggtttgaattagccaggcagatactagatacctgagaccatcaggagaatcacttctgattaggcagaataagaacgggcactggaattgccactccataggaataaattgtctaggaaatgaaccaaattgtgtgcttaatatcagtctactcctttgttagcttatttcataagctattagcataaatgtaggtcgttggcttttttttttctcaattcaactcaaaaattttgagatcattgtgagaaatatacacttgtaagaaataatacagagattccacccggttttcccaatgataacatcttgcaaaacaagggcaatatcacaaccaagccaagataggatagaaatgatataatcaagatacagaacatttctatcacaatgatcccatctgttgtcataagccatattcagtttcctcttgtgctcgtatagctatgcccaccttcataacctctggcaccagcggtctgttctccatctctaattttgccaaaattgattggattatactttcttttgggattggcttttcactcagcataatctctgggcattgatccagcttgttgcatcaatagttctgtttttagtactgagtgggatgtcagtatagatgtaccatagtaaacacctgtggaaggacgtcaggaatgtttcctgttattaggtatctaaataaagttgctgtaaacatttgtgtac

SEQ ID NO: 89910 - DNA, 515 bp, Homo sapiens
cttgtaccaattgaatggcagaactactatagtcaaaaataaattcctatcctatttttaattgatgggatataggcagcacaatttcccttcattgttgaagccaacaagttccgtaacagaactccagaggtaaatagctgggaaaactgttagttttaaggtcccactgttgctctgtgaatgactaatcagaggaagcccaaaaatcagccaactaatttcagtttatgtctttaattgtgatgtaagtgtgaagtttctacatatgggtaatccagggttgagttaggtagtttgcaaacatgacttttgctggaggaacttttaatcatgtcttattaatttctggtcccaataattaattttcttacagtcaaacccaatgcacttgaaaaataatataattaatactgtgtgaagaattttttgcatgttaaaaaaagcaaaccactagtttgcttagttctggcattcataaactactgtaccttctgttctattgacatgtttgg

SEQ ID NO: 89911 - DNA, 196 bp, Homo sapiens
gcactggtctcaaactcctgacctcaagtgatccacctgcctcggcttcccaaagtgctgggattacaggtgtgagccactgtgcccagcctgtatcaaaaaatttttaaacaaaactgcaaaaattattgtagccaacccagaaaaaaactctcctcaatattatctgttattatgtctaataaagaatattcac

SEQ ID NO: 89912 - DNA, 756 bp, Homo sapiens
tgtaaaatagaaaaaggaccttctgctgctcctcaggatggcgggacttaggggccatgtacatgacgatggcgctgccaaagaagagtcccactacgcagaggtgggaggagcaggtggagaaggcctttctgcggccctccccagactggatcctcaggatggccgccaggatgtgtgagtaggagaccagcaccaggcagagtggtcccaccaggatgaacatgcaggctgcaaagatgaccacctggttgagccaggtatcagcacaggccagcctgaggacagacaggatttcacagaagaagtggttgatttcacgaggcccacaaaagggcagtcttaggatgaggctcacatggaccatagccaggagggagccacatgtccaggaagtgatggccagagtgatgcagactttccaggtcatgatgatgaaatatcggagagggtggcagatggccacgtaccgatcgtaggacatcagcaccaacaggaggcattcagtatgtgcaaaactcaaaaagagaaaggtctatgtcatgcagccagcaaaggagatgggcttggctggatgcaggaggttcaccagcatctggggcactgtgttgcaggcataggcgatgttgacgacggccaggtgtgagaggaagaagtacatgggggtgtggagtctggagtccagtgagatgagccccaggatggtcccattccccagcagggtgaagacatagaacagggagaagagcccaaaga

SEQ ID NO: 89913 - DNA, 187 bp, Homo sapiens
gcaagtgatagggcatagaggatggaaattaaggacaagaagcccagtggtgtagcaccaatctatccaagtccagagatgaaacttgagggcagagacagaaatttaattgttagaaaagtatacaggttagtggttagaattaagctctggactcaaattgcctagtttcaaatcccaaatcctt

SEQ ID NO: 89914 - DNA, 652 bp, Homo sapiens
cacagatgctaggtggcaaagccagtcttatgactccaaaaccaggcatctgtctcaccattctaaccctgctacgtcacacaaatccaggagagagaatttacataaagcactgcatgcgctttggaagaaatgctgtacttaattaagtgaaggtaacctcccagagttagccagcctttcagagttgaagtcacagcttagggattcaaaatgagctactaaaaacactaatttagttattagagaactccgggttccactttcaggatccaccttggttggccagtggaaaaacacaagtattcttcattcaacaagtactgaaggacctattattggcaatgaacgtaacatgtgttctttccttggggactgcaggtgggcagaaggacctgttcagttttactttcaaagaaaagatccacatttgaggtttctttaagtgtaccatattttaagaaagaaaatgtactattttctccagagtgaggggctaaggtgtgaagaacagatataaaatattaaaatgtattcagatgcccttcacacagcaaggcttgtgatgccttcatggaagtgatcaaccctatcataaacattgttagatgtggtattaaagtataaactgatgacagtactattctccaca

SEQ ID NO: 89915 - DNA, 428 bp, Homo sapiens
tttttttggagggatggggtctcattctgtcacccaggctggactgtagtagtgcagtcatggatcactacagcctcatcctctggggcttaagtggtcttcctgcctcagccttccacatagttgggactacaggctcacaccaccatgcctagctaatttttttgtttttttaattttttgtggagacagggtctcactgtgttgttcaggctggtcgtgaacttctggcctcaagtgatcctcccacctttgcctgtccttttaatagctactggggcttgtacttttatttgtttgactgtttgaaagctgatgtgagaggttttgtgacttgggaatatcgaactttgctgtcttagaggatattgatgccatctgtcttcaggtaggataatgggtgtgttttagaagtgggtggttataaa

SEQ ID NO: 89916 - DNA, 415 bp, Homo sapiens
attaataaaccagtctggagcccaaaccttaccaggctgtcaaactgctggcagaaagctaaatgtaaggccaggttgaagaaggcagtcagattgcagggagttgagcaggtcattcgaccctcactattattgctccaagttgaacatactgacccttttgaaatgggcaaagtgggactttaagaatctagtgattgaaaagtcaaaggaaatctgataccatcttcttttgatattgcagcatttcctgtcacaactcctgatttagttttgtaatgctagaactattcctatttccttcttggaaaattccctccacgtcctagagtacttcctcaggtctaaatagctaatgtttacaaaggaaggattaagtaagacgaagatgacacagcagagttttccattaaga

SEQ ID NO: 89917 - DNA, 741 bp, Homo sapiens
tgttacttcctgaaatctataaaccaaaacttaaaagcacaatcaacaaatctagaaacgctaggaatttcctcacgttaaaaaaataaaagatccaagaagctcaaaaaataacaactttctgcactgccttcttttaaagacacgttgatctcaggacagaaaagccaaactcttccaatgacaattacaattgcaaaccaaaatacagagcatatattgctgtctaaaagtgagtagatcttggccaggcgcagtggctcttccctgtaatcccagcaagaggccaaggcgggtggatcacttcaggccaggagttcgagaccagactgaccaacacagcgaaactgcatctctattaaaaatacaaaaaattagctgagtgtggtggcaggcgcctgtaatcccaaagtgatggaattacaggcccgagccactgcgcccggccacaactattttaatagtgttgttttggtgttggttgattaaaggaatgggaacgaatgacttgaagccctctctgtttcactctttatacaaagtggagtccagattgggctagtggcctgtctagccaaatgtctgacttggacatacattactgtccaggagtttcttagctgaatgtgataaatgccttccgtgacatcatccttacaggaacctttttacatttattctttacttctgttgatgggttgacgtcgggggacctctagagtcactgcaggctgcaactgg

SEQ ID NO: 89918 - DNA, 3258 bp, Homo sapiens
  misc_feature (1110)..(1110): n is a, c, g, or t
  misc_feature (1112)..(1112): n is a, c, g, or t
gtgcagaacctttgcctcctggccagagggacccttctgcaggctgattccagcagtgcccgatggtgggacccacaccagaccaagccttcgcctcccagaggcctcctggccctcctgtcatggcctgtgagagccacacccctaggccccgtctcctagtctgcaggccgcaggaccagctgcccacggccccagggggcaagggctgtagatgagggtctcagaggtggtgggagcaccccccccacccacagttcctgggcatttctttagagctttaaaatggcacctggagaccaccaggcgcggcgatcagatcgggtggtgtggtgcctcctgggactgaccacttcttgctctccgaccaggcaggggcgagtggcctgggaggttcccggaccctcagggggcctgtgtctctgggcaccgcagctccgccccactccttcctccagaacattccccactcgggctagagaattgcgtctgctccaggaatgcatcctagcgtgtgtacgatcgcgcctgggtgtcctgttctcatgagcaagcggttttaaccagcagcataatttatactcatagacaggactgggggaagggctgttcctgaggctggggtgcagtgccttggaaagcacccctgaaacagtggaccttgtatttttagtgtcccctgcaaccatcctctgacttagagcaagaatttccgctgctgctacccccgagatgggcttcaccagatgttaataacgtgcttattttctctaagtgctattttggcaccagcgttagttgcaatttatattctgcagcatttgatgctgggaaaagaacccaccctaatggtccccaattggcagagctcggctgttaagcagcagaccatatgctgcctgctggaggagcgtggtcagcacttgtccccgtgcctgcgtgcgtgtgcctgcgtgcacgtgtgcctgcgggtacctgtgccctgtgtgtgcacatgtgcctgcatgcgtgtgcctgcgtgcacgtgtgcctgtgtgtacatgtgcctgcgtgtacctgtgccctgtgtgtgcacgtgtgccttcgtgtacctgtgccctgtgtgtgcangngtgtgtgagtcacgtcttccgtgtgtgtatgtgagggagagactgtggggttggagggagggaggaggggaaagggtatgtatccctttgttctttaaaagggagagccccaacctctctggctgccccctcctgcctgtgctcccagctcaccccacacctagctgctatttattctcctgacccccttcccggccctgcagccccgtgtcccgcagcctccgccccgcctcctgctccacgtcaccaggcaacactcggctccaccaggcttccgaaggtggcccagagcaggcacttgagcctgatgacccagagcaaagctgcctttctgggccttgagtactcctttctgctatggaaggcttttcttgttttcaacggcccgtccagcccaggggggctgggtgagggccgcttccttctgcagcagagggggcgggctctatccttgccatctgctgcccccagaggccctgccaggacatgggcctgagcggtttcttctccaagaggccctcctgggacctgtctgtgcacagggcgggaagacacttgctgcttcgacccaggacggcagccaggacgggctgagctcctcttgcgctgcaaacacacaagggttgcctgccagctcagcagcgccctccctcaaccacaccctgggtccggacccagagccacaggccgttggacccaggggaccggggctgggctcaggcgtgggcctggagggcttgtggaggggccagacctagagccgtagggctccaacagctgagggctgggcccctgccggccaatgaagctccagaccagtgctccggccttggcggtgccagcagtgctcctgcagggatggagggtgctggaggcctggatgcggggaccttgatcccccagcaggcagcgctgtggtcccagccactcaggaggctgaggcgggggaatggcatgaacctgggaggcggagcttgcagtgagctgagatcgcaccactgcattccagcctgggcgacagagtgagactccgtctcaaaaaaaaaaaaaacaaaagaagtttctagatctactgggcatgatgaacacaaaccccacagacactgaggaacccagtggtggcagtgactcgggctcctctgctctctaaagctcctttgagaaacatgggaggggccgggcgtggtggttcacgcctgtcatcccagcactttgggaggctggggcaggaggatcgcttgagcccaggagttcgagaccagcctgggcaacatagtgagactgtatcgctacataaaataaaaaaaaaagttagctgggcattgtacatgtgcctgtggtcccagctactcaggaggctgaggcaggaggattgcttgagcccaggagttggatgttgcagtgagccaagatcgcaccattgccctccactctgggccacggagcaataccctgtctcagaaaacaaacaacaaaaagcagaaacgctgaaggggtcggtttacgggaaaaccgcctgtcagaacacttggctactcctaccccagatcagtggacctgggaatgagggttggtcccgggaggcttttctccaagctgttgccaccagacccgccatgggaaccctggccacagaagcctcccggggagtgagccagagcctggaccgctgtgctgatgtgtctggggtggagggagggtggggagtgtgcaagggtgtgtgtgtgcccggggggtgttcatgggcaagcatgtgcgtgcctgtgtgtgtgcgtgcccctcccctgcagccgtcggtggtatctccctccagccccttcgccaccttctgagcattgtctgtccacgtgagactgcccagagacagcagagctccacgtggttttaaggggagacctttccctggacctgggggtctcgccgtatctcatgaccaggtgctaaatgacccgacatgcatcacctgcctttcgatgaccaacctccctgtccccgtcccgctgacctgcccccgtggcgtctcacggtgatgcctgctcctgacattggtgttcactgtagcaaactacattctggatgggaattttcatgtacatgtgtggcatgtggaaaatttcaaataaaatggacttgatttagaaagcca

SEQ ID NO: 89919 - DNA, 608 bp, Homo sapiens
gtgcagaacctttgcctcctggccagagggacccttctgcaggctgattccagcagtgcccgatggtgggacccacaccagaccaagccttcgcctcccagaggcctcctggccctcctgtcatggcctgtgagagccacacccctaggccccgtctcctagtctgcaggccgcaggaccagctgcccacggccccagggggcaagggctgtagatgagggtctcagaggtggtgggagcaccccccccacccacagttcctgggcatttctttagagctttaaaatggcacctggagaccaccaggcgcggcgatcagatcgggtggtgtggtgcctcctgggactgaccacttcttgctctccgaccaggcaggggcgagtggcctgggaggttcccggaccctcagggggcctgtgtctctgggcaccgcagctccgccccaactcaggggcgagctgcaactctcctcccgggaccctccgggttctctgtccgccaagaaggtccggactgaggagaagaaggcaccgcggagagtgaacggagaagggggcagcggcgggaacagcaggcagctgcagccgccggcagctcgcccctgagtt

SEQ ID NO: 89920 - DNA, 1518 bp, Homo sapiens
tggacgtgggcagagcgctgctgccagttcctggtagccttgaccacgacgctggggggtctttgtgatggtcatgggtctcatttgcacttgggggtgtgggattcaagttagaagtttctagatctggccgggcgcagtggctcacgcctgtaatcccagcactttgggaggctgaggcaggcggatcatgaggtcaggagatcgagaccgtcctggctaacacagtgaaaccccgtctctactaaaaatacaaaaaagtagtcgggtgtggtggcgggcgcctgtggtcccagccactcaggaggctgaggcgggggaatggcatgaacctgggaggcggagcttgcagtgagctgagatcgcaccactgcattccagcctgggcgacagagtgagactccgtctcaaaaaaaaaaaaaacaaaagaagtttctagatctactgggcatgatgaacacaaaccccacagacactgaggaacccagtggtggcagtgactcgggctcctctgctctctaaagctcctttgagaaacatgggaggggccgggcgtggtggttcacgcctgtcatcccagcactttgggaggctggggcaggaggatcgcttgagcccaggagttcgagaccagcctgggcaacatagtgagactgtatcgctacataaaataaaaaaaaaagttagctgggcattgtacatgtgcctgtggtcccagctactcaggaggctgaggcaggaggattgcttgagcccaggagttggatgttgcagtgagccaagatcgcaccattgccctccactctgggccacggagcaataccctgtctcagaaaacaaacaacaaaaagcagaaacgctgaaggggtcggtttacgggaaaaccgcctgtcagaacacttggctactcctaccccagatcagtggacctgggaatgagggttggtcccgggaggcttttctccaagctgttgccaccagacccgccatgggaaccctggccacagaagcctcccggggagtgagccagagcctggaccgctgtgctgatgtgtctggggtggagggagggtggggagtgtgcaagggtgtgtgtgtgcccggggggtgttcatgggcaagcatgtgcgtgcctgtgtgtgtgcgtgcccctcccctgcagccgtcggtggtatctccctccagccccttcgccaccttctgagcattgtctgtccacgtgagactgcccagagacagcagagctccacgtggttttaaggggagacctttccctggacctgggggtctcgccgtatctcatgaccaggtgctaaatgacccgacatgcatcacctgcctttcgatgaccaacctccctgtccccgtcccgctgacctgcccccgtggcgtctcacggtgatgcctgctcctgacattggtgttcactgtagcaaactacattctggatgggaattttcatgtacatgtgtggcatgtggaaaatttcaaataaaatggacttgatttagaaagcca

SEQ ID NO: 89921 - DNA, 1015 bp, Homo sapiens
gaaaggcgtccaggataagaagcgaaatttaatcttaagaattatctggccgggcgcagtggctcacgcctgtaatcccagcactttgggaggctgaggcaggcggatcatgaggtcaggagatcgagaccgtcctggctaacacagtgaaaccccgtctctactaaaaatacaaaaaagtagtcgggtgtggtggcgggcgcctgtggtcccagctactcaggaggctgaggcaggaggattgcttgagcccaggagttggatgttgcagtgagccaagatcgcaccattgccctccactctgggccacggagcaataccctgtctcagaaaacaaacaacaaaaagcagaaacgctgaaggggtcggtttacgggaaaaccgcctgtcagaacacttggctactcctaccccagatcagtggacctgggaatgagggttggtcccgggaggcttttctccaagctgttgccaccagacccgccatgggaaccctggccacagaagcctcccggggagtgagccagagcctggaccgctgtgctgatgtgtctggggtggagggagggtggggagtgtgcaagggtgtgtgtgtgcccggggggtgttcatgggcaagcatgtgcgtgcctgtgtgtgtgcgtgcccctcccctgcagccgtcggtggtatctccctccagccccttcgccaccttctgagcattgtctgtccacgtgagactgcccagagacagcagagctccacgtggttttaaggggagacctttccctggacctgggggtctcgccgtatctcatgaccaggtgctaaatgacccgacatgcatcacctgcctttcgatgaccaacctccctgtccccgtcccgctgacctgcccccgtggcgtctcacggtgatgcctgctcctgacattggtgttcactgtagcaaactacattctggatgggaattttcatgtacatgtgtggcatgtggaaaatttcaaataaaatggacttgatttagaaagcca

SEQ ID NO: 89922 - DNA, 3748 bp, Homo sapiens
  misc_feature (1110)..(1110): n is a, c, g, or t
  misc_feature (1112)..(1112): n is a, c, g, or t
gtgcagaacctttgcctcctggccagagggacccttctgcaggctgattccagcagtgcccgatggtgggacccacaccagaccaagccttcgcctcccagaggcctcctggccctcctgtcatggcctgtgagagccacacccctaggccccgtctcctagtctgcaggccgcaggaccagctgcccacggccccagggggcaagggctgtagatgagggtctcagaggtggtgggagcaccccccccacccacagttcctgggcatttctttagagctttaaaatggcacctggagaccaccaggcgcggcgatcagatcgggtggtgtggtgcctcctgggactgaccacttcttgctctccgaccaggcaggggcgagtggcctgggaggttcccggaccctcagggggcctgtgtctctgggcaccgcagctccgccccactccttcctccagaacattccccactcgggctagagaattgcgtctgctccaggaatgcatcctagcgtgtgtacgatcgcgcctgggtgtcctgttctcatgagcaagcggttttaaccagcagcataatttatactcatagacaggactgggggaagggctgttcctgaggctggggtgcagtgccttggaaagcacccctgaaacagtggaccttgtatttttagtgtcccctgcaaccatcctctgacttagagcaagaatttccgctgctgctacccccgagatgggcttcaccagatgttaataacgtgcttattttctctaagtgctattttggcaccagcgttagttgcaatttatattctgcagcatttgatgctgggaaaagaacccaccctaatggtccccaattggcagagctcggctgttaagcagcagaccatatgctgcctgctggaggagcgtggtcagcacttgtccccgtgcctgcgtgcgtgtgcctgcgtgcacgtgtgcctgcgggtacctgtgccctgtgtgtgcacatgtgcctgcatgcgtgtgcctgcgtgcacgtgtgcctgtgtgtacatgtgcctgcgtgtacctgtgccctgtgtgtgcacgtgtgccttcgtgtacctgtgccctgtgtgtgcangngtgtgtgagtcacgtcttccgtgtgtgtatgtgagggagagactgtggggttggagggagggaggaggggaaagggtatgtatccctttgttctttaaaagggagagccccaacctctctggctgccccctcctgcctgtgctcccagctcaccccacacctagctgctatttattctcctgacccccttcccggccctgcagccccgtgtcccgcagcctccgccccgcctcctgctccacgtcaccaggcaacactcggctccaccaggcttccgaaggtggcccagagcaggcacttgagcctgatgacccagagcaaagctgcctttctgggccttgagtactcctttctgctatggaaggcttttcttgttttcaacggcccgtccagcccaggggggctgggtgagggccgcttccttctgcagcagagggggcgggctctatccttgccatctgctgcccccagaggccctgccaggacatgggcctgagcggtttcttctccaagaggccctcctgggacctgtctgtgcacagggcgggaagacacttgctgcttcgacccaggacggcagccaggacgggctgagctcctcttgcgctgcaaacacacaagggttgcctgccagctcagcagcgccctccctcaaccacaccctgggtccggacccagagccacaggccgttggacccaggggaccggggctgggctcaggcgtgggcctggagggcttgtggaggggccagacctagagccgtagggctccaacagctgagggctgggcccctgccggccaatgaagctccagaccagtgctccggccttggcggtgccagcagtgctcctgcagggatggagggtgctggaggcctggatgcggggaccttgatcccccagcaggcagcgctgtggtcccagccactcaggaggctgaggcgggggaatggcatgaacctgggaggcggagcttgcagtgagctgagatcgcaccactgcattccagcctgggcgacagagtgagactccgtctcaaaaaaaaaaaaaacaaaagaagtttctagatctactgggcatgatgaacacaaaccccacagacactgaggaacccagtggtggcagtgactcgggctcctctgctctctaaagctcctttgagaaacatgggaggggccgggcgtggtggttcacgcctgtcatcccagcactttgggaggctggggcaggaggatcgcttgagcccaggagttcgagaccagcctgggcaacatagtgagactgtatcgctacataaaataaaaaaaaaagttagctgggcattgtacatgtgcctgtggtcccagctactcaggaggctgaggcaggaggattgcttgagcccaggagttggatgttgcagtgagccaagatcgcaccattgccctccactctgggccacggagcaataccctgtctcagaaaacaaacaacaaaaagcagaaacgctgaaggggtcggtttacgggaaaaccgcctgtcagaacacttggctactcctaccccagatcagtggacctgggaatgagggttggtcccgggaggcttttctccaagctgttgccaccagacccgccatgggaaccctggccacagaagcctcccggggagtgagccagagcctggaccgctgtgctgatgtgtctggggtggagggagggtggggagtgtgcaagggtgtgtgtgtgcccggggggtgttcatgggcaagcatgtgcgtgcctgtgtgtgtgcgtgcccctcccctgcagccgtcggtggtatctccctccagccccttcgccaccttctgagcattgtctgtccacgtgagactgcccagagacagcagagctccacgtggttttaaggggagacctttccctggacctgggggtctcgccgtatctcatgaccaggtgctaaatgacccgacatgcatcacctgcctttcgatgaccaacctccctgtccccgtcccgctgacctgcccccgtggcgtctcacggtgatgcctgctcctgacattggtgttcactgtagcaaactacattctggatgggaattttcatgtacatgtgtggcatgtggaaaatttcaaataaaatggacttgatttagaaagccaaaaaaaaaaaaaaaaaaaaaaaaaaaaaaaaaaaaaaaaaaaaaaaaaaaaaaaagggggggggggcaaaaatcccccggggggggccctcgcgagcacccccacgtgttttttgtgaacaagggggcgcgccccaaaatagggagcgcgcggatatatataccaccgcgaagcgcgaaggcgcggcccgccgggcgtaataaaaaacaacggccgctgagagcggcgagaacaaccgcgcctgccgcgagagaacagctgtgatgggcagagagcacccctaatctcgtgggggggggggcccacacatgttgcgcaacacacaactcatcacgacgagagatttataaaggcctaggggggaacattattaaaaattggagggtggtttatgcggtggcaaacacacgcgcgatttgtcttgagcgacataaaaatttgtgccacacggggttgatcttgagacaattttattgcggcggtgcgaata

SEQ ID NO: 89923 - DNA, 3117 bp, Homo sapiens
  misc_feature (1110)..(1110): n is a, c, g, or t
  misc_feature (1112)..(1112): n is a, c, g, or t
gtgcagaacctttgcctcctggccagagggacccttctgcaggctgattccagcagtgcccgatggtgggacccacaccagaccaagccttcgcctcccagaggcctcctggccctcctgtcatggcctgtgagagccacacccctaggccccgtctcctagtctgcaggccgcaggaccagctgcccacggccccagggggcaagggctgtagatgagggtctcagaggtggtgggagcaccccccccacccacagttcctgggcatttctttagagctttaaaatggcacctggagaccaccaggcgcggcgatcagatcgggtggtgtggtgcctcctgggactgaccacttcttgctctccgaccaggcaggggcgagtggcctgggaggttcccggaccctcagggggcctgtgtctctgggcaccgcagctccgccccactccttcctccagaacattccccactcgggctagagaattgcgtctgctccaggaatgcatcctagcgtgtgtacgatcgcgcctgggtgtcctgttctcatgagcaagcggttttaaccagcagcataatttatactcatagacaggactgggggaagggctgttcctgaggctggggtgcagtgccttggaaagcacccctgaaacagtggaccttgtatttttagtgtcccctgcaaccatcctctgacttagagcaagaatttccgctgctgctacccccgagatgggcttcaccagatgttaataacgtgcttattttctctaagtgctattttggcaccagcgttagttgcaatttatattctgcagcatttgatgctgggaaaagaacccaccctaatggtccccaattggcagagctcggctgttaagcagcagaccatatgctgcctgctggaggagcgtggtcagcacttgtccccgtgcctgcgtgcgtgtgcctgcgtgcacgtgtgcctgcgggtacctgtgccctgtgtgtgcacatgtgcctgcatgcgtgtgcctgcgtgcacgtgtgcctgtgtgtacatgtgcctgcgtgtacctgtgccctgtgtgtgcacgtgtgccttcgtgtacctgtgccctgtgtgtgcangngtgtgtgagtcacgtcttccgtgtgtgtatgtgagggagagactgtggggttggagggagggaggaggggaaagggtatgtatccctttgttctttaaaagggagagccccaacctctctggctgccccctcctgcctgtgctcccagctcaccccacacctagctgctatttattctcctgacccccttcccggccctgcagccccgtgtcccgcagcctccgccccgcctcctgctccacgtcaccaggcaacactcggctccaccaggcttccgaaggtggcccagagcaggcacttgagcctgatgacccagagcaaagctgcctttctgggccttgagtactcctttctgctatggaaggcttttcttgttttcaacggcccgtccagcccaggggggctgggtgagggccgcttccttctgcagcagagggggcgggctctatccttgccatctgctgcccccagaggccctgccaggacatgggcctgagcggtttcttctccaagaggccctcctgggacctgtctgtgcacagggcgggaagacacttgctgcttcgacccaggacggcagccaggacgggctgagctcctcttgcgctgcaaacacacaagggttgcctgccagctcagcagcgccctccctcaaccacaccctgggtccggacccagagccacaggccgttggacccaggggaccggggctgggctcaggcgtgggcctggagggcttgtggaggggccagacctagagccgtagggctccaacagctgagggctgggcccctgccggccaatgaagctccagaccagtgctccggccttggcggtgccagcagtgctcctgcagggatggagggtgctggaggcctggatgcggggaccttgatcccccagcaggcagcgctgtggtcccagccactcaggaggctgaggcgggggaatggcatgaacctgggaggcggagcttgcagtgagctgagatcgcaccactgcattccagcctgggcgacagagtgagactccgtctcaaaaaaaaaaaaaacaaaagaagtttctagatctactgggcatgatgaacacaaaccccacagacactgaggaacccagtggtggcagtgactcgggctcctctgctctctaaagctcctttgagaaacatgggaggggccgggcgtggtggttcacgcctgtcatcccagcactttgggaggctggggcaggaggatcgcttgagcccaggagttcgagaccagcctgggcaacatagtgagactgtatcgctacataaaataaaaaaaaaagttagctgggcattgtacatgtgcctgtggtcccagctactcaggaggctgaggcaggaggattgcttgagcccaggagttggatgttgcagtgagccaagatcgcaccattgccctccactctgggccacggagcaataccctgtctcagaaaacaaacaacaaaaagcagaaacgctgaaggggtcggtttacgggaaaaccgcctgtcagaacacttggctactcctaccccagatcagtggacctgggaatgagggttggtcccgggaggcttttctccaagctgttgccaccagacccgccatgggaaccctggccacagaagcctcccggggagtgagccagagcctggaccgctgtgctgatgtgtctggggtggagggagggtggggagtgtgcaagggtgtgtgtgtgcccggggggtgttcatgggcaagcatgtgcgtgcctgtgtgtgtgcgtgcccctcccctgcagccgtcggtggtatctccctccagccccttcgccaccttctgagcattgtctgtccacgtgagactgcccagagacagcagagctccacgtggttttaaggggagacctttccctggacctgggggtctcgccgtatctcatgaccaggtgctaaatgacccgaaaggcaggtgatgcatgtcgggtcgaccggccgccgaatttagtagtagtag

SEQ ID NO: 89924 - DNA, 470 bp, Homo sapiens
cttcagtcgctcttggcttcagtcgctcttgtgtgcaagggtgtgtgtgtgcccggggggtgttcatgggcaagcatgtgcgtgcctgtgtgtgtgcgtgcccctcccctgcagccgtcggtggtatctccctccagccccttcgccaccttctgagcattgtctgtccacgtgagactgcccagagacagcagagctccacgtggttttaaggggagacctttccctggacctgggggtctcgccgtatctcatgaccaggtgctaaatgacccgacatgcatcacctgcctttcgatgaccaacctccctgtccccgtcccgctgacctgcccccgtggcgtctcacggtgatgcctgctcctgacattggtgttcactgtagcaaactacattctggatgggaattttcatgtacatgtgtggcatgtggaaaatttcaaataaaatggacttgatttagaaagcca

SEQ ID NO: 89925 - DNA, 2233 bp, Homo sapiens
  misc_feature (1110)..(1110): n is a, c, g, or t
  misc_feature (1112)..(1112): n is a, c, g, or t
gtgcagaacctttgcctcctggccagagggacccttctgcaggctgattccagcagtgcccgatggtgggacccacaccagaccaagccttcgcctcccagaggcctcctggccctcctgtcatggcctgtgagagccacacccctaggccccgtctcctagtctgcaggccgcaggaccagctgcccacggccccagggggcaagggctgtagatgagggtctcagaggtggtgggagcaccccccccacccacagttcctgggcatttctttagagctttaaaatggcacctggagaccaccaggcgcggcgatcagatcgggtggtgtggtgcctcctgggactgaccacttcttgctctccgaccaggcaggggcgagtggcctgggaggttcccggaccctcagggggcctgtgtctctgggcaccgcagctccgccccactccttcctccagaacattccccactcgggctagagaattgcgtctgctccaggaatgcatcctagcgtgtgtacgatcgcgcctgggtgtcctgttctcatgagcaagcggttttaaccagcagcataatttatactcatagacaggactgggggaagggctgttcctgaggctggggtgcagtgccttggaaagcacccctgaaacagtggaccttgtatttttagtgtcccctgcaaccatcctctgacttagagcaagaatttccgctgctgctacccccgagatgggcttcaccagatgttaataacgtgcttattttctctaagtgctattttggcaccagcgttagttgcaatttatattctgcagcatttgatgctgggaaaagaacccaccctaatggtccccaattggcagagctcggctgttaagcagcagaccatatgctgcctgctggaggagcgtggtcagcacttgtccccgtgcctgcgtgcgtgtgcctgcgtgcacgtgtgcctgcgggtacctgtgccctgtgtgtgcacatgtgcctgcatgcgtgtgcctgcgtgcacgtgtgcctgtgtgtacatgtgcctgcgtgtacctgtgccctgtgtgtgcacgtgtgccttcgtgtacctgtgccctgtgtgtgcangngtgtgtgagtcacgtcttccgtgtgtgtatgtgagggagagactgtggggttggagggagggaggaggggaaagggtatgtatccctttgttctttaaaagggagagccccaacctctctggctgccccctcctgcctgtgctcccagctcaccccacacctagctgctatttattctcctgacccccttcccggccctgcagccccgtgtcccgcagcctccgccccgcctcctgctccacgtcaccaggcaacactcggctccaccaggcttccgaaggtggcccagagcaggcacttgagcctgatgacccagagcaaagctgcctttctgggccttgagtactcctttctgctatggaaggcttttcttgttttcaacggcccgtccagcccaggggggctgggtgagggccgcttccttctgcagcagagggggcgggctctatccttgccatctgctgcccccagaggccctgccaggacatgggcctgagcggtttcttctccaagaggccctcctgggacctgtctgtgcacagggcgggaagacacttgctgcttcgacccaggacggcagccaggacgggctgagctcctcttgcgctgcaaacacacaagggttgcctgccagctcagcagcgccctccctcaaccacaccctgggtccggacccagagccacaggccgttggacccaggggaccggggctgggctcaggcgtgggcctggagggcttgtggaggggccagacctagagccgtagggctccaacagctgagggctgggcccctgccggccaatgaagctccagaccagtgctccggccttggcggtgccagcagtgctcctgcagggatggagggtgctggaggcctggatgcggggaccttgatcccccagcaggcagcgctgtggcagcctcccacctcctcttcccctgttatctgctccttttaggatctgaaaattacagagccttttttttttttttgagagggagtcttgctttgtcccccaggctggagtgcagtggcacgatctcagctcactcactacaacctccacctcacaggttcaagcgattctcccacatcagcctcctgagtagctgggattac

SEQ ID NO: 89926 - DNA, 300 bp, Homo sapiens
tgcatcacctgcctttcgatgaccaacctccctgtccccgtcccgctgacctgcccccgtggcgtctcacggtgatgcctgctcctgacattggtgttcactgtagcaaactacattctggatgggaattttcatgtacatgtgtggcatgtggaaaatttcaaataaaatggacttgatttagaaagccaggcggctgtgtggtccttccagcacggatactttgacctcttgcctacaaccccttccttgggtccgaggctggtagctttgttcacttccgatggttgggggcgggtg

SEQ ID NO: 89927 - DNA, 523 bp, Homo sapiens
gatgcgatgattgttgaagcatgtatcaagatgaaaccttcttcagactaggtttctaaatgagcacattaagcagagccccgtgaagttgaacatgtagtatgagcaaaatataaaatttatttttaagccactgaaattttaggattgtttgttatggcagcataacctaaaccatcctgactcatataaaaattggctcctagatatgggttagtgtaataacaacaataagcataacaacaataaaactaaacaatcatttagagggcgataactaagaacactgctatcagaagctgaagggatggtgatctgtttggtaaacatatcacctgtgataatgtagaaggcagatcatgaacctgatgaactaaagaaaaggattgtaaaacagagagtgagtagtgtgtgttggtggctgttggatgcattctgaaagttactacaagctattcaaagatgaactcagaaaaatttggcctgtttgcaatcaggaatgaaatggaatagagaaaaccta

SEQ ID NO: 89928 - DNA, 279 bp, Homo sapiens
tctttagtttgatcaattttatcagtaatacattttaacatccaatattataattaaaagacctctcaacaattattgattgcttgtttctctaagtattaataatttcctcagttatgatttctataaaattgcatttgaaatcttgaattggtatttaattttgaacttctttaaagccaccataaatgttctttaatattatgctaaaaaaaaatcaatagacaaggtgttttaaatcatttgtccaaattttatattgaccatatgttacataag

SEQ ID NO: 89929 - DNA, 378 bp, Homo sapiens
taaaaaaatttcagtatcaaaatctattgtgaatatgctattaaaatttaaaacaaaagtatttttacctctgagtcacatactatgtaatagagttatagacaggttaatgactatttcaatctgtgtaaagtgtgcaatgatcatgcctaaaagtcacttcagaaaattagagaaacatgacaatgtagaagggacagcaaaaacactacacatttgaatataaagtagaattcataataaaatgcatctgaatacttgtataattactcaaaagcatactggaccctgttttttaccaaagcattataaaaaaaattaactgaaattgacagtgaattgttttaagtagcacttctaagatttcatttacatact

SEQ ID NO: 89930 - DNA, 386 bp, Homo sapiens
tttttggaaaatttttacagaacatggaaataatgcaaaaggaagactggacatcatttcaatgttatatactagaatattatttaattatcttaagagagtgtttgccattaggatccagagcctatgaaattacgtatttacctgcagattcttatccagtagagatgcaaatcatttctgtctactagaaaagacagtccccaaagttatagttttattgatctttaggacttttatcagttttatatgtaacctatcaaatattttctaacatttttcttcagtacctatacatactttgtttcccaaataccttttgaactgggtttactatcctgctggttcccttataaatgagtcaaataaatctttcacatatgctc

SEQ ID NO: 89931 - DNA, 769 bp, Homo sapiens
ggaggatacattggaagcatcattcaggaactcactcgttcttattttgcagttatagtttgttagacacatacagccttttttccagaagtgctgtcccaggactaggacagaccctggcgagttgtaactcggctgaacagcagccacactcagtgctgtgggcctgtcagccatggtccggccctgacatgactagtggctcttctgaccctactgcttggaactataattcgtgtgtcctcccttactaggaagttattgaacttctgatcccttttatcatttccttaaactgtttgcccatgtatagtaagagtatgcttggtaagctgactgcagtcctagcattggccttagccatgattagctctagcaaggcgaggctggcaggtttgatttccatgcctcaggctcaggcaggatccacatccccaggtgccctcttccaacagaagctatctgctagtggggctcctgcctttctagcctgctttccccgacggaagttgcaggcaaaggttgtcattggagacagccatggagacagccgcggggcagtcctgctttaccctgcacggtgtgaattgtggctcccatttgtcttggtcccgccagggtttggatttctgctttgagagtgtgttctggagagaaaggaagtgaatgctagacctcatctttctccccaaatcggcttctattaccagaaagctgaagcctcctgcaggtcttggggggaaaataacaggaagagctatggtctcaa

SEQ ID NO: 89932 - DNA, 313 bp, Homo sapiens
agcacacacatccttcacaattcctatccatgacagctctgggacgagccggctctggagccaggtgaccacccctgtgcctgaaggtgggagagcttcctcccaaagaattgcatgtgttaattcacataattgtgtcactgcagacactcactgaaaggttagctgtgatactgccactgccaccaccatcatatcatgatttcatcaccatcaccgccgctgccacctcatcaccaccatcactgttaccacccagcaccaccaccacgtgtgaactttctactctgcagcaggtgtgcggctcaagatt

SEQ ID NO: 89933 - DNA, 257 bp, Homo sapiens
ctagactccatctcaaaaaaaaaaaaaaagttgataacatcacatctatgcaataaattatttaaataagtacataattatattgagaaattaaagacataaagcaagctaaaacatttaaatcatttattattggtacagcagattttcaaatataggactaaagattcagattactggtcaggcgcagtggctcacacctgtaatcccagtgctttgggagactgaggcaggtggatcacttgaggtcaggagtt

SEQ ID NO: 89934 - DNA, 339 bp, Homo sapiens
tcaggaggtagagaccagcctgaccaacatggtgaaacctcgtctctactaaaaatacaaaaattagccgggcatggtggcgcatgcctgtaatcccagctacttgggaggctgaggcgggagaatcgcttgaacttgggaggcagaagttgcagtgagccgagatcacgccattgcattccagcctgggcagcaagagtgaaactccacctcaaaaataaataaatacatacatacatacatacatacataaattgtcaatttacaatataaaaaagaaaagattaataaaatcaatatacctctaccaaggctattcgaaacaaaaaggtacaactt

SEQ ID NO: 89935 - DNA, 542 bp, Homo sapiens
tgaggagtttcgctcttgttggctaggctggagtaaaatggtgcgatctcggctcactgcacctccgcctcccaggttcaagcgattttcctgcctcagcctcccgagtagctggggttacaggcatgcaccaccatgcctggctaattttctgtatttttagtagagacggggtttctccatgttggtcaggctggtcttgaactcctgacctcaggtgatctgcccgtctcggcctcccaaagtgctgggattaccggcatgagccactgcgcctggccgacaaaggctttgatatcagaatgaactgtcaagggaggtgctggagagggattaacctgtgctgcctgggaccctcagggtcttaggttggggagtgtgaataggagtttgcagatggagaataggaagggcattccaggcagagggaaacctgtgcagagaccaagaggtgtggaaggaaaagtggggttggggctgggtggtctggattatggcctggatgcaataaagtactgtgacagtagccacctatttgtttt

SEQ ID NO: 89936 - DNA, 1872 bp, Homo sapiens
cttctatttccgcacgctgttccagcagcacaacgaggccgtgaatgtctggacccacctgctggcggccctggtactgctgctgcggctggccctctttgtggagaccgtggacttctggggagacccacacgccctgcccctcttcatcattgtccttgcctctttcacctacctctccttcagtgccttggctcacctcctgcaggccaagtctgagttctggcattacagcttcttcttcctggactatgtgggggtggccgtgtaccagtttggcagtgccttggcacacttctactatgctatcgagcccgcctggcatgcccaggtgcaggctgtttttctgcccatggctgcctttctcgcctggctttcctgcattggctcctgctataacaagtacatccagaaaccaggcctgctgggccgcacatgccaggaggtgccctccgtcctggcctacgcactggacattagtcctgtggtgcatcgtatcttcgtgtcctccgaccccaccacggatgatccagctcttctctaccacaagtgccaggtggtcttctttctgctggctgctgccttcttctctaccttcatgcccgagcgctggttccctggcagctgccatgtcttcgggcagggccaccaacttttccacatcttcttggtgctgtgcacgctggctcagctggaggctgtggcactggactatgaggcccgacggcccatctatgagcctctgcacacgcactggcctcacaacttttctggcctcttcctgctcacggtgggcagcagcatcctcactgcattcctcctgagccagctggtacagcgcaaacttgatcagaagaccaagtgaagggggatggcatctggtagggagggaggtatagttgggggacaggggtctgggtttggctccaggtgggaacaaggcctggtaaagttgtttgtgtctggcccacagtgactctctgtgcacgactcaactgccaagggcatcactggccaattcttggatttagggattggctaggagttgctggggtccactcctgggcctgccccagctccttgcccagggagagggaaagagttaacggtgtgggccactccagcttgcccttccactgccactcactggggtgaggctgggggtcagcttggtgaggattggggcttctagattgtctaggcaggaggtgaaacttaggccagagtcagatttgagctgagccaggggaggccttggcaacctacttctactcagatttcattgctggatgcggaaggggtaggcccaaaatatatacaggatcttactgtcccttgaagcccagccacaagtgttggagctgcagagagaccccaaaggtagtagattgtgccagatacaaatgggtcccatccagtgcttcatactccttcagtcactatcccagacagtgagccccagatctcctagctctggcttctgtgtcccacacggcctgttcccagcttctctcctggttcccttgttacggattcatttatccattcagtgtttcctgggcctctgctcagaggcaggtcaccactgggccctgtggatcaatgcaagatgacaaaggctttgatatcagaatgaactgtcaagggaggtgctggagagggattaacctgtgctgcctgggaccctcagggtcttaggttggggagtgtgaataggagtttgcagatggagaataggaagggcattccaggcagagggaaacctgtgcagagaccaagaggtgtggaaggaaaagtggggttggggctgggtggtctggattatggcctggatgcaataaagtactgtgacagtagccacctatttgtttt

SEQ ID NO: 89937 - DNA, 711 bp, Homo sapiens
cttctatttccgcacgctgttccagcagcacaacgaggccgtgaatgtctggacccacctgctggcggccctggtactgctgctgcggctggccctctttgtggagaccgtggacttctggggagacccacacgccctgcccctcttcatcattgtccttgcctctttcacctacctctccttcagtgccttggctcacctcctgcaggccaagtctgagttctggcattacagcttcttcttcctggactaaaaaaaaaaaaaaaaaaaaaaaaaaaaaaaaggggggggcgcgccccaaaagattttccccccgggggggccccaagttatagccgggcgttaccccagctttttttgttaaacaagggtggtccccattataatgggggggcgcgatataattatataagccataggacacccgggccgcgccgcgtttttaacaaagcgttcggtgaagcgagggaaaaacgcgtggctagcgtgggggactctgtgggtgagggaaccctaacttgcgtgggggcggggcaccattatgggggaccaaatctaccctagtcagaagaattttaaggcctcaaggggtaaattattaaaacttttcaaggctggtattagtgggtggtcaaaacctagcgctgaaatagtgctggccggcctgaaaagttggggctaacgcgggtatgattgttgaaatttttatcg

SEQ ID NO: 89938 - DNA, 386 bp, Homo sapiens
taagcaacacttaacaaacaaatgtgtacaccagaaggtcatgttttcatttaccttgggaagtctgtctaaccagataactggttgtataaatagggcaaaactttttaatagggagagctagtacccagggagtcattttaagactactcattccctggactcagttgtatacttgctgaagtgacaattgtcttagtagacaatacatacactgaatagacagagaaggaccctaaatccttgctttagagtagtacaatggaatactgacaaattcttattcagaaacatactttctacgctcacacaaaacactatatttgtgtttgtgactgccatcagcatagaataatttccagggtttcagtctattgcatattagt

SEQ ID NO: 89939 - DNA, 951 bp, Homo sapiens
gttgcaaccataagttacaccatattttctcaaagaaacatggtagtaatcagaggccattgttcaaagtactgactttagtcagctgacctgcaatcaaacctcagtttaggcacttactagctgtgtgaccctgggcaaaatacttaacctctctgagcatcacatactcatctgtgatatgaggactgcaatacattcctgctttctttttttgacaaatatttattgagaatttctttacttgtggaatgtggtattatgtcctgtgtttaatggtctttatatgtatctcccagttcagtttcatataaattggcctcttgtttctgtaactaggattgcatttctgtcaaaagtcttggcttatacaaggacgctcaaaggccatccaatctgcaaatacaagacagagctgcctcaggaaatgcccgatgatttaattaaaatgtgaagagtagcccacagagagggcaggtgtggtgtaaccccaccctgcagggatgaggcgggcatcctccttctcggtgacttagcctggagtactaccttggagtagtttcagagacggttctcaggacaaaaagttgacccctgttttagggaggctgccttgtggccactgggcatgctgatggtttgccatctaacactttatgcctctcacttgtccccattttgagtccaggcaactgtgacccctggaattatggagagtctcttgggactgtcgttattatttttattcttactgaggtaaaattcacataacataaaattaagcatgttaaagtagacatttcatttagtacatttataatattgcacaatcacccactatctagttccaaaaatcatttttttgagtttctattttgatatgattttaacctaggaaaaaaattacaagaattgtacaaggaactctgcataaccttccaccagatatat

SEQ ID NO: 89940 - DNA, 147 bp, Homo sapiens
ctcccaaagtgctgggattacagacatgagccactgcacccggcctacagttttgatatacagatactgtttcttctttttgctgaacatgatatcaaactaagagctaatggtggctaccatcaattgatgtcttcctatgctatg

SEQ ID NO: 89941 - DNA, 259 bp, Homo sapiens
ctgaactcagccaatgcccacccacatagagagcatttagacaagccctagccaaagggaaacaccccaattcagtgattgaaacttgagttctggcgagccttaccacaggctaaagtgcttgagagccctcaataactcaaaacaccgtctaggccacaaagacttttagatgagttctagtgctgagttggactcagagacaatggacttgggggccatgccacctattaaaacatcagctggggtggttgagaga

SEQ ID NO: 89942 - DNA, 371 bp, Homo sapiens
atcatctttggtcaactcttggctggacccaatgatagtgtaggaattaacataatttttcctactaaaggtattggatttgttttgagagaccacagtttaatatcattgacatagaaagtttaaaaattgttagactaaaattttttagtgctgttgaagttgttttacagaaaaatatctatcctggtttacattgatagttttttttataagaactagatcaagagaaagggagagtagtgataaatgtccaggttttcgagttgaaaagtaacaatcagtgtattacaacagatagatttgatgtcaaattgcaaatgctgaaaacgttatatgtaattgactagccagagtaattatacaaggca

SEQ ID NO: 89943 - DNA, 257 bp, Homo sapiens
ttctgggagagggaatcaaatgtacaaaagcagaactggggtgaaatcctttggtacatccaaagaactgggctgatcagcatgactggagagtggtatatgtggcaggggcaccagctcttactttttttggatccctaaccaaggaatttgagcagtctgatcaaatttacatctagaaatgttatcttggcagccatgtggggatggactgtaaggaaatgagactacaggcagggagaccagctaggagacta

SEQ ID NO: 89944 - DNA, 275 bp, Homo sapiens
ccttccacctcggcctcccaaagccctgagattacagacacgagtccctatgtctggcttttttgagcatttcttaaatgcccaagtgaggaaaggaccaaatcagttttccagaaccactcgtgaatgactggatatgggggcttgcacaaagccggggccctgcattgccgagagcttttagccctgaatacttttctttgtattatgagatgtcactgtaggtttacagtctttggaagggcccaagaaagatttccccaaagatcttattt

SEQ ID NO: 89945 - DNA, 370 bp, Homo sapiens
acataagtaaaagaaaatgaaaccagtgggaaattatattccattatattaaaaatgttaaaatagcaaagctcttttatactttagttatgaagtatcttttctaagttttttttaattgcatcaattagattttgacatttagatatgtcagtgtttagaaattttaattctcaaaatactttggaaaagggtacagaaatttttccggtctatgttctgtaagatatcacttatcaactttgtagagaaatgattttctactttctcagggtcagtggtattgaatggccactagaaccgtactaaaataccatgttacaaattgggtattccttatctgaaatgattgagtccagaagtttttgga

SEQ ID NO: 89946 - DNA, 2024 bp, Homo sapiens
  misc_feature (889)..(889): n is a, c, g, or t
  misc_feature (1655)..(1655): n is a, c, g, or t
tagactgtgtaactgaaaggatcatctttcgggtcatcttttgtcccaagtgcttagtcatattgagctaatgtcaagatcttgtgttgtttagtatctttagagttcgaagcacaaaccccggagatttttgtattctttcagtgccttcgtgaggagtaggcaggtataaaatagaaaggtaggctcagaacaaaaaaaaagtatttggaatacagaattctgatacacatgactctgcctctctgggtgaataaagagaagagaaactggactcagttgtacagaccacctagtaactgaccatggtgtgatttttaaagcgaggaagcagatgccaggcagtgaagacttgcacaccgtcacactgttaactggtagagaggcagtgctgtatcttccgcttctcctaaacgttggtctagggttcatcctgccttatagcacatgtttagtatacatatccaaggaagtttttttggtcactgaggctgaaccttatggacagtactgctgatttagtgatctgaccttgaattaggggtttcacaagaatccaggtcctggtccatggaagaacagtgagcacttttgataattgaggtctagcttaacattctgtgaccaataatattttagttaacagagattctggttcttggatcgaggatattatgtttaacaggaaaaggctctgaaagatgtaatctctctttttttcaagttgcatagattgcacatgaggattttgcccacttagcaacttcattctacttttgcaggaatagaacccaagtcttctgactttcactgcattagcttattttttcctcatttttagttctttcaagaatcattaattccatgcttgaaaatgtctgaatggcantaatgaggataagttttttaatcttttgaattcttaatgtgaactaacaggaaaaaaatctcagagctaacaaattagagttggtaaagggccgatttataagtgtctcacaatttatgggtgtaaatcaaaatgttaactagtacagtcataagctgtttgtacaatccttaggctttaacttctttggaattggcaagctaggcatttgacatgtatttatataactgtacggttgtagttattaatgatcttgtcattattgttgataatgaaaaaagatcttcactataatttcttcgtataattcttataatgaaacaagtaaatactattaactagaaaaaatctagtctgcagttagcccacacacatccaaacttatctctgccagcagcaaaagaaagcttgaaaacctttgccaaaatcagaagtttcccatttagattacataagtttctgttgaattgaaatatatttagataacatttaaaccattgatcttttggtattaactctcagatgtttcataactttctgtctttttagtattcagggatattatgtaaagtttttcctgcactgaatctctgtgcttgagcctactgaaatgatccccctaagccatgctgcctgccttttgtgtttaatgtttttttacactgacttatctccttcgtgtgttcacctctcccccagaggaagacaacagaacagtataatttacagtttgtacaggttaaaaaaaaaaaaaaaggttgtaagntgggggggtgatattttgttttaaaatatttgggtaaggaaaattttgtctttaatattaattctgtaatccttgaccaggcatggtggctcaaacctgtaatcccagcactttgggagaccgaggcgggcggatcgcatgaggccaggagttcgagaccagcctggccaacatggtgaaaccccgtatctactagaaatacaaaaaattacccaggcgtggtggtgcatgcctgtagttcccgctactccagaggctgaggcagaattgcttgaacccggaaagtggaggttgcagttagctgagaccacaccactgcactccatccagcctgggcaacagagcaagactcagtctcaaaaaaaaaaa

SEQ ID NO: 89947 - DNA, 575 bp, Homo sapiens
tatacagtgtatgttaatcgagtggatggtttaaaaaaaaccttatagagaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89948 - DNA, 310 bp, Homo sapiens
cgagatcccccatacagagtacagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctgtatgggggatactggtagcgagctcga

SEQ ID NO: 89949 - DNA, 1169 bp, Homo sapiens
tctgctctgtaccggattgctgcgcacgtgtgcaaccccaaggttgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcctcccgcggcccacagagcacagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89950 - DNA, 1607 bp, Homo sapiens
tctgctctgtaccggattgctgcgcacgtgtgcaaccccaaggttgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcctcccgcggcccacagagcacagtcagacagaatctccctctgtcacccaggctggagtgcagtggcatgatctcggctcactgcaacctccacctcccgggttcaagcgattcttgtgcctcagcctccggagtagctgggatttacagacgtgcgctaccatgcccggcaaatttttctatttttgcaaagacaggatttcaccgttttgtccaggctggtcttgaactattgacctcaagtgatccgaccgccttgacctcccaaagtgctgggattacggggtgtgagccatcgcgcctggccactttctccaaagttttaaaccaaagccttcttcggcagagctacgacccttcctctatggcccattctatcctatgctgcttccctttataaggacactcccactgttgtgctataatcatctcttggtatctccagactctgccactctgagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89951 - DNA, 1004 bp, Homo sapiens
tctgctctgtaccggattgctgcgcacgtgtgcaaccccaaggttgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcctcccgcggcccacagagcacagacagactgtttttgccaaccatggcatctggagatgacagtcctatctttgaagatgatgaaagccctccttacagcctagaaaaaatgacagatctcgtagctgtttgggatgttgctttaagtgacggagtccacaagatcgaatttgaacatgggactacatcaggcaaacgagtagtatatgtagatggaaagaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89952 - DNA, 572 bp, Homo sapiens
ggtgcgggccatcgtaattctgtcgtctacccacacgcgcccacctaaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89953 - DNA, 618 bp, Homo sapiens
agctttagactttgtttttcaaagcttattgtttaactaatacattattttattgcactactagtacttttagatggtgtgaatgctctagacagagataaaagtttctgcaccactaattccttcttcttttgttgctccagggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89954 - DNA, 284 bp, Homo sapiens
cctgggttggggctgaggaaggcctatgcgcggagggtgcggccttcggctaaggcagaggaccagggttgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagc

SEQ ID NO: 89955 - DNA, 957 bp, Homo sapiens
ggccatctctgggcggcggcggcgggcggtgtctgcgcggtcggtgagacccgcgcgggtgagacgctggccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89956 - DNA, 927 bp, Homo sapiens
gagatccgccactctgcctcccaaaatgccgtgattacagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89957 - DNA, 1021 bp, Homo sapiens
aatttcttaggtactgtcactttaatattttgacattttagaggttttaatctaatattttcatcttggaaggattaattggttatttaattagtattttggcctactataattgctttattttattcctttagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaataaaaaggggctcgttggctctta

SEQ ID NO: 89958 - DNA, 831 bp, Homo sapiens
tctgctctgtaccggattgctgcgcacgtgtgcaaccccaaggttgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcctcccgcggcccacagagcacagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcgggccagaagggcgtggccagaagaacgtggccagaaagaggtagcgagctt

SEQ ID NO: 89959 - DNA, 431 bp, Homo sapiens
gtgagaaattaaatttcaaaatgtaattattaaatgtatgcctgagtttcaaatgtttttctatatccagctaattaaaaatatttataacgtagtagtagttaaatgtcatgttcaccttattagaaagaatgccttcaaatcagtattatcatgattaccatttatttaacatcttcagtatgcagggcatttataaaatctgtagaaattaattttctctaaatgcaacaagctttatgaccagcactcactgtctataaaagatgacttgcttggcagaagaggaaacagtttcttcagaccttccagccacagtcagccctggtgacattgcatatcaggtaaacccccaatccctggccacatttgattggtccaagatggaatgtgacccaggctgagacaatcagactcagtctcttgataat

SEQ ID NO: 89960 - DNA, 526 bp, Homo sapiens
gtgagaaattaaatttcaaaatgtaattattaaatgtatgcctgagtttcaaatgtttttctatatccagctaattaaaaatatttataacgtagtagtagttaaatgtcatgttcaccttattagaaagaatgccttcaaatcagtattatcatgattaccatttatttaacatcttcagtatgcagggcatttataaaatctgtagaaattaattttctctaaatgcaacaagctttatgaccagcactcactgtctataaaagatgacttgcttggcagaagaggaaacagtttcttcagaccttccagccacagtcagccctggtgacattgcatatcagcttctaaagggcctcgcacattccttggcttgtgatgtcccttccccatcatcaaagacagcaacgaaacttcaggctaccatacctgcttcaactgtaggagaatcttagttctggagagttgaccctccaggcgaagcattaggctttgatacaatttgtctggtaccggctgtagatct

SEQ ID NO: 89961 - DNA, 161 bp, Homo sapiens
ttattttcatcctcataaattaagcagttttgtagcagaataattcagaagcagtaattgttagtttctatgcctagccaatatctaccctaatttcacaataatggttttaggattaaattttgtgagatttttccataatgctaaacatgtgtttattt

SEQ ID NO: 89962 - DNA, 1753 bp, Homo sapiens
  misc_feature (228)..(228): n is a, c, g, or t
  misc_feature (1749)..(1749): n is a, c, g, or t
  misc_feature (1751)..(1751): n is a, c, g, or t
caatttacattcgttttgggacctactgtaaaaaatactgtttatttatgtagctcctcacaattcctctggtcaaaataacaaaatatcccttgatgcatttattatcttgtggactgttttcttggagtctcctgattttcctcttcttatatgtttatccatttttactttaaatttatatttaaatgttgggcttcatctctctttatacatttcatgggtggnctcacttgttactattaatttacataggacctgcatgccaacaatctcaaatttacatctcagcccagacctcttttctgggatccagacttgtgtatccatacatctacttgatacctcctcttgtatgtcccagaaacatacaaacagaaatgttcaaacttggtgtgttgattcacccctgttctgtcagccaggtcttatttttttctattttttttttccaattgatagtatatggtgccaacattcacccagatagtcaaaccaataaatacacaagtaaagtaaaataaataactaaataaaactagaacatatcattgacttatttctcccatcatctgtatgcatatgcaatctattattaaatcctagtagtgctatcttgtaaaataattctccatatagccatctgttttcgtttgcttgcgctgccataacaaaatcctgggaggcttaaacaacagaaatctctttctcacacttctataggctgggaagttaaagatcaaggtgccagcatggtcagttcctcataagggtgttcttgctgacttgtagatgactatctttttggtgtgtccttacatcatggagagagcagtctggtatttctttctcttcttataaggatatcagtcctatcaaattaggaccccacctttctgacctcatttatcttcaattccctcctcacaggccatatgtgaggcagtaattgaaggcttcaatacatgaattttgtgggagccctctctctgtttccgcggccaccatccttgtcctaatcaccagcatctcttatctgtcaattcaacagactcttaattgtcttgctgctttcagtgttgctttctgcaatttgttttgtagtgagaaatcaaagtggtcttttaaaaatttaattacttaattttacttccctgcttaaatccttgaatggtttctcattgcactgtgaatgtaaacaaaatcctttagcagggcctctaagaccataccttattctccctctctgtcaaaaaacactggtgatactggccttctgccacattctagaataacataccacataccttttcacacaccaaattctcaaatctccttcccctgtacccggaatacaattctgtcagcacttcaccttggctacctctttgccatacttgtcatctcagctgaaacatcacttcatcagagaggtcttctccaattgctgaggggttgatggatgcagcaaaccaccatggcaggtgtatacctatgtaacaaacctacacattctgcacatgtatcccagacttaaagtataataacaaaaaaaaagaatctttaaaaaaataaaataaaaatagtaacaatagcagcagcagcagcagcagcagcaacagcagaaaatcaactggtcacctaaatcctataccataacatattgctagttcaagttcaatttaaacagacaaaaatatacaaactctgatttacaaaaaaatgaattttagggaataattttccacngnac

SEQ ID NO: 89963 - DNA, 338 bp, Homo sapiens
gttttaacagaaaaatataattcttttccttagcctcaatgactctgccctcttttgtctctaaatgctgagagttccttcatttcaatgttaaaacatttaatgttaagtgatttctaacctcatgtaaccaatctataaggaagtgggttcaggaacaatttaaatggcattctcaacaatgagcagcataataggaaacaggaagcaaagatgtcagatttctaagtgatgtttcatcttctcaagcatatgattcttggcagaacccaaccgatcttcagaaacgagaaaaaggtcaatctttctatgtgaaagcacttaactggaaaagaatt

SEQ ID NO: 89964 - DNA, 1234 bp, Homo sapiens
gaggaaagcccgagggttgtgggtcctgctatagccagggccaagctccaggaaatcgtggccattcaggggtagtttgcagcctcatttgtaacattattgtgttgtcctgtgcatttccaatgcattacataaagacatggtcgcttttaggagaaatgtctgaaaaactaagaagatgcagaaaggaactgactgcagccattgaccgggcctttgaaggagttagttattcccaggagtgcacaggccagcagaggctggaactgagcgccgcgccgctctccttctcgctgcccgtgcacaggctcctctgcagaagacatcctctggcagcctgctcttctgctgctccttttgctgctgtcccatgtgctcctgagaatgagaaccctgcctttgcaacaaaccatgccccggtaaatgcaaaaccacatgctctgtgccccgagagaaaacctctaaccagcaaggaaaatgtattgatgcattcctccattttggcacctgaaagagagtcttggagaactgcaggagagggggaaaactggagaaaagaaaatttaaggaaagatatggagagagatttgaaggctgactcaaacatgccactcaacaattctagccaagaggtcacaaaggatctgcttgatatgattgaccatacaagcatccgaactattgaagaattggctggaaaaatagaatttgaaaacgaattgaaccacatgtgtggtcattgccaagattcacccttcaaagaggaagcctgggccctgctcatggacaagagccctcagaaggccacagatgctgaccctggcagcctcaaacaggcttttgatgatcataatattgttgagactgttctggacttggaagaggactacaatgtgatgacgtcttttaaataccaaattgagtaaggacagttatctaagctttgattccttacagcaggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgtgtttttttgattgatgttcaatatacccagtacccatggtaggtgtgggtcatgggcctctgc

SEQ ID NO: 89965 - DNA, 927 bp, Homo sapiens
tggctgggcagcagtttattaccctaaagaccttgtttccttgtttttttttcacattgtgtcttgtcatccctgagagccaggacaaccatgtacatttctataccctcccacttatacctttcttggggactggcatatagttggaactcactaaatgcttgggcctgaaaggaaggtaccaaacccaccttaatttggcagtctggcagcctgcctgtcctggggcaggaatgcctgcttttacacaatccctgataaatgacaacccattcatggtttttaacttgcacctgaaatgtcttcagaaaccttccactggaattgtaaagctgaatgttcttatttttaagaccatacaagcatccgaactattgaagaattggctggaaaaatagaatttgaaaacgaattgaaccacatgtgtggtcattgccaagattcacccttcaaagaggaagcctgggccctgctcatggacaagagccctcagaaggccacagatgctgaccctggcagcctcaaacaggcttttgatgatcataatattgttgagactgttctggacttggaagaggactacaatgtgatgacgtcttttaaataccaaattgagtaaggacagttatctaagctttgattccttacagcaggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgtgtttttttgattgatgttcaatatacccagtacccatggtaggtgtgggtcatgggcctctgc

SEQ ID NO: 89966 - DNA, 916 bp, Homo sapiens
gaggaaagcccgagggttgtgggtcctgctatagccagggccaagctccaggaaatcgtggccattcaggggtagtttgcagcctcatttgtaacattattgtgttgtcctgtgcatttccaatgcattacataaagacatggtcgcttttaggagaaatgtctgaaaaactaagaagatgcagaaaggaactgactgcagccattgaccgggcctttgaaggagttagttattcccaggagtgcacaggccagcagaggctggaactgagcgccgcgccgctctccttctcgctgcccgtgcacaggctcctctgcagaagacatcctctggcagcctgctcttctgctgctccttttgctgctgtcccatgtgctcctgagaatgagaaccctgcctttgcaacaaaccatgccccggtaaatgcaaaaccacatgctctgtgccccgagagaaaacctctaaccagcaaggaaaatgtattgatgcattcctccattttggcacctgaaagagagtcttggagaactgcaggagagggggaaaactggagaaaagaaaatttaaggtgattctaattttgatggtttaacagctacaattaaggggattcttgtttctgaaaaagttgttgaagatcctagatttagttcatgacagtgctcttgcctcctcttggcagctctgtgactgcatttggggagttgacagacattcttcagaatctggcctaggaaacagttatattttgtgtatatgttccagttgaggggctagttgtcaatcgttgatgtcaaaaaccagtcatggaaaccactttgcagtacccaaaggggtagtggatgtaaaataaccgggttttaaaaataaccttattttttaagttgcagaaacaaaagtcttaattccatcttaa

SEQ ID NO: 89967 - DNA, 867 bp, Homo sapiens
atttccttcaccctgctataattttctggatcacatatgttgcctttaacattttccatattatttattttcccactgtatgtaaagcccaaggactttttttcactgctatatcccaagaacctaaaataaatctggcatgtggtaagcgtacaataaatatttgttgaattaatgaatggagaataatgaatgcatgatgaatggcttctctgggagaaataccttgaaggggggcaagagcagaaagaggaatatcagacgggacattcttcaagtcgagtgttgatagagtcttggactaggctagagccaacagaaatgaaaattagtcatttggtttgagatacatttttggaaggaggatgaacagaatatgcaggtggactggaatattgaagagaggggctgtggtaaatagcctccaaaatggccccaatggtccttgccttttggcatttgtgcctttttgtggtcccctcccacactgaacgatgcagatctgggtaatcagtatatattgcagaagtgattgtgtgtgacttccatggtgaggccataaatggcatggacacttctgccctgctctcttggacagcttattttgggagaggccagccgccatgtcatgaagacactcaagaagccctgtgaagaggaagcaaggcctgccaacaacagccagcaccaactttccagccaagggattgagccatctcacagtggatcctccagcccccaccaagccttcatatgaccaaaccaataccaacatgtaactgtgacctcatgtgagtccccaagccagaatacccatctcctgtctcagaaatgatgagaaataataaatatatgtgctcacacata

SEQ ID NO: 89968 - DNA, 623 bp, Homo sapiens
atggcactattgcagagaaaagttcaactgcctctaccctgacttaccattttatagaaggatgatgcccagaataacattatcttaaatactcccaagatttataagaaggccgaggatttctgcccagacacatgaaaataaggcagcgaaggaaaaaattaaagccagtactgctttttaaaacatgcggtttatatgtaagacttgcagaattaaaatcaacctcaacaaaattcaaggcagtcaaataatgttcttgaaaagtggttaccctctgagttacatttttaacattaacagacatggattttttgggaagtggatgctgtataacatttgtattctcagcattttctgtatttatttaagccagtttgttttccccagtgatcctatgtctttgagacctcgctcttgacaatggtggcttcaggagcaaggccccaaattgccaggcattgctattgtgttgaagccacgctgctgcttttccctcctcatatcctgagcatgctttattatttcttccatttataacctctagttctgctcccacaaaaccaaaattctctggggggtaaaaacttagctacaacattccctgaaatagcgattagatt

SEQ ID NO: 89969 - DNA, 336 bp, Homo sapiens
tgagccattattgtggattttaatggttcagtgattttaattgtggctttaactgcatttttctgatgattaataatattaagcatcgtttcctgtacttaatgaccgtttgtatattttcttttgagaagtgtctctgtaaatcatttgccctttttaatgaggttgtcatcctgttacttatttgtaaatgttttttacatattctagatttgtgtttcacaaccaaggaaatcttatccaccaaaggatatttgaaaatgtctagagacatttttggttgacacagttgagggaggcctgtacctgtctcccttcctcttttctccatctctc

SEQ ID NO: 89970 - DNA, 474 bp, Homo sapiens
gagaaagagggcagggtcgggcggtcgccagcgttcgccggcaggaaaggtgagggtacctgtgcagtcgggggaccccttgaaactttccggagttgcacgcagaggcaatccccgcggcccccaggcctgggttccggaacgccgaagcgacgccggtttgtggcttaacgtgcagctgatgatcagagtgagccctctcagatgctgctccgagcgcctgggaccaaggacacgtcgggattagaatgggccgacctcccctccccgctggggtgttgcatcggctcccagctgaagcctgacagcccttgggggagtcccccaggttgcctgagtagcgccccgttgtcgttcagtcccctccaactaggtgcagggacccagggaggcgcgcgaggaccgacccgtcaccgctcaaattacctcatcgcccagctccccgcccccttcccaaacctggaaggaaccttg

SEQ ID NO: 89971 - DNA, 321 bp, Homo sapiens
ctctttccctccctccctctctttctctcccagtttctttcccaactttttattttggaaaatttcaaacttgctggttgggagaattataaaacaaatttcaaacttgctggttgggagaattgtaaaacaaacactttatgtcctctgcctaaattcaccatttgttctacatttgcaacatttgctttattccctcttctaattatatatataaattatacatattatataaaattttgctgaaccatttaaaagtaccaaacatcttgacactttacctctaaatatttcaccacccgtcccctaagaataaggaca

SEQ ID NO: 89972 - DNA, 437 bp, Homo sapiens
aatttttgtatttttttgtagagacagtgttttgcaatgttgcccaggctggtctcgaactcctgggcttaatcgatccacctgccttggctcccagtgttgagattacaagcatgagccaccacacctgtcctgtctcatgggattgttagtggctttgtgtttccaaaccaaaaaaaaaaaaccacccagctaaattaaattcccctccacacagaacctggataaagttgtagaacagtggggcaatctcagctcattgcaaacttcacccaccaggttcaagcgattctcctgcctcagcctcccaaagttcagggattacaggcctgagccactacacctgggcccagaggctcttttctaagttttttttttttttgtcaatgtacaacatgctaaagagggaaatgggccccaataaatggttgatgttg

SEQ ID NO: 89973 - DNA, 648 bp, Homo sapiens
cagcctcccagagtgctgggattataggcgtgaggacaccatgcctggccatgacttctgatagggagtgctgatttaatggctttggaactaagcatctagcactctgtcttgggagctgcagagatctggtgtgcatacttggcagagatgctatgaatctgcctgcctttgaatggaccatatggatttagacaatggtcatcccaggagcaaccatgacagactgaagaccagagtctcttttttttttctctctttctttattttatttttgtattttttagaaatggggtctttctatgttgcccaggctggtctccaactcctgggctcaagtgatcctcccgccctcagcctcccaaagttcagggattacaggcctgagccactacacctgggcccagaggctcttttctaagttttttttttttttgtcaatgtacaacatgctaaagagggaaatgggccccaataaatggttgatgttggttgtctttccaccctagtaaatggggttttgagcccgagttaatttaatttagaaaaattaaataatgtgttgtttttttttttgctcctcagtgatgtggaacacatttatactctaacatttattatctcatttaatcttttttcttctttctt

SEQ ID NO: 89974 - DNA, 333 bp, Homo sapiens
caggttgttcttgctctcccttattttacatttatccttccttcccaactgcctgtccgatagatgtcgagtcccaacatcagatgtgaagatgagagctttatagagactgcttaaccagctcccacagttgtattaggacaaatccctgtagcaaatccctttgtgtgtgtgtgtgtgtgtgtgtgtgtgtgtatgtgtgtgtgtgtgcgcgcgcacgcgcgtgcacgcaccttagtggttctcctgtgattgaatcctgacttacacagtttgagatagaaaccttctgaagcaattagattaaatggtctataactgtgctgtccaaca

SEQ ID NO: 89975 - DNA, 333 bp, Homo sapiens
agaggatttttgtaatgcttcagtgctgaaagggctatatgggtcttttaataataataatcctgattatttttacatttttgttttttaatttcctccttcagatttctcttacagcctaagattggtaagaagaacactaatgtttcctgcaggagttgtctatgagatagcactaaagaaaaaaatgagaagaccaaaccggattttacaagcataaaataaacttgagacttagtttatcctctaaatcagtagttctcaaccaggagtgaatgtgcccttcagggggtatatgacatgtctggagatatttttgagaagccagagatg

SEQ ID NO: 89976 - DNA, 548 bp, Homo sapiens
attttgatcttttgaattatgattctcagggttttagactttaaggattctaatcttttgggatttcaatatttggaattttagagtttgagattgtgtgtttcaagattatggctcaaatccagtttaatctgctagcagacaatcccagagaggtaacaaataaaaagcaataatttctggcaacccagccaggctgcctttgtgtcattgtataaaacctgatgaatacaagatagtagacagtgatatgtcatacattaaattcaatgatgggccaggtgtggtggctcacgtttgtaatcccagcactttgggaggctgaggtggcagatctcttcagccaggagttcgagtcctgcctgagcaacttggcaaaacctcatttctacaaaagaatacaaacattaggctgggcacagtggtgcacacctgtaatcccagctactgaaaaggttgaggtgggaatattgcttgggcggtaaaggctgcagtgagccatgatggcaccgctacactccagcctgggcgacggagcaagaccctgt

SEQ ID NO: 89977 - DNA, 269 bp, Homo sapiens
ggcgcatgccaccacatctgggtaattttttgtatttttagtagagacggggtttcaccatgttggccacgctagtctcgaactcctgacctcgtaatccatccgccttggcctcccaaagtgctgggattacaggcatgagccaccgtgcccggcccaaagtcgttgagttttaagaataactatatattgagctatctgtttgcttatttttatagtaaacatatattttacatatagtaactctattacatacaacatatatattt

SEQ ID NO: 89978 - DNA, 370 bp, Homo sapiens
ccattcatttgtcttaagtgtatctttttctttatgtttaaagtgtcttgtagatagcatgtaattaggtcttcctttaccaattctgacaatccttgccttataattagagttcagtctgttaatgtaagagtaaatatcgatgtggcttgatttattgctaccattttattatttgccttttatttgtccttttggattttttccctgtttttcctttccttatcaatgaaatgtatttgagatttccattgtggtttatctaatgctttttaaagctattcttctttgaattattattttagtggttactctggtgtttgaaatatgcacccttggccaggtgcggtggctcacttctgtaatccca

SEQ ID NO: 89979 - DNA, 470 bp, Homo sapiens
ccggtccagatgaggcagagaacccaagtggatttggggagtagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgcttaatgcttacctgatggcaacttctggctctggaaccgctactctgccctgttcccagccacttcccaacctgattcaagcagggcccctccttcctcctgtctttatttatttatttattgagacagagtctcactctgtcgcccaggctggagtgcagtagcgcgatctcggctcactgcgagctctgcctcctgggttctctgcatcctct

SEQ ID NO: 89980 - DNA, 4451 bp, Homo sapiens
  misc_feature (4447)..(4451): n is a, c, g, or t
ggcggcatttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgcgtatgattggcctttggagctacatgctccaacaaactgtatcttaattgttaactgttaataattatctggcccagaaaaagagatgcagtgattttacccttcacaggaatattgaacttcttctgtaaaagagagagagaaacctctctctttcatgcaccacatggaaacagagtgtggccctgaagttgtggctttctttgtgtcaaaactgtggtctgagtttttagagaaggaaaaatgctactcagtgagaaatccaagaaatgaaaccaggaaggttttcagatcacatttcccagagtgagttcgggagaatcttgcctgtcgtgatcacactgttccccgccgccccaggtcagcacatacttgacccagagtgggctctcaggatttgttgattgaagggtgggtgaaagctggctggagactcctggcctggccacctgcaagaggcggactttgaagaaaactgtgatccagttgagccactttgtccctgaggggaatgctgctttgcagctttctgtaacttctcacatgggaattgcactggtgacagataaggtttaacagatgtacttttttatcctcagaataagacaaggcaaactctatatggctagtattactgagtcaggtccctcccgttgacccattaattccagcattgatcaatacaaccaaattccagccccaggacaagagtggcaggcatgggggcctggtactccaggctacagtgtgagcccaggtgttctgcaccttgcagcctgcacactgcaggtgaaatcatgagcagtgttctggagtgtgaagtgtttttatttttttgttaatgtattaattccttttagatattaacccccctcagaactatatgcacaaactataacttggatgttaataatcctgtcactcagtgccccaaaccttctgtgtctacacctagagagagggccagtaagggcaactcctatcatgcattaaaatgcatgtatttaaatctgcttgcccagagccagtacccaggggctaaggattaagacctgtcagtacaccaagactggggcccagtcacctggcaggtttttatctactcagagggagaatgctttgcactaagtgggagaaaagcagctaaatgcaaggtgtcctgagcaattagaggacctccaaagcatggcctcagtcatgccttcatcgggcaaggtcaggccagctcagaaaaatggatggtcccatagggtcaagtggagcacacacggaaggcagtcctccttccctcccatgtcctttctctgtccctggcatccacagaaagggaccttcagtcctcatgagctgcttctctgcagctgctgatcaccctcccggaaccctgcacctatcccgtgcccacctgaccccagactcaagcatgatcctcattctacctgcctcggaatcacctggattgcaagtcagaacatggcttcccaggacccactccaggccttcagggtctgtgtctcccaggaggagggctctgagattggcttttctggcaagcccacgtggctttgatgccaccaaggttggcatgccccattgtcttccttcgtgacaggcccaggaccatcatgctcatgctcacagtgcctgttctctgctccaggaacagagctgctgctctacaagcagccttgtgactccggggtctctgggagcaggactccccaggcttgtgctctctcagcttgagagaggctctatgtctgaaggcagtgctcactctctcatccctcccctgctgttcgcccagtgctgctgtcagggccagctcctcttgaaagacagccagccgcaaaggcagcccagggcttcttccggtgtcctgcttccctgtatctagggagagttgtacatgtggctgcgtgttttcccaggactagccctgccgcctgggctgtcagcactttggcagcaggtcctctgtggttctctgcctctggtgcctccctaaagctcagctggacctgaccaggcctctggcatttcccctgctggaccccctagagccacagctgtgcctcagggagcttgcatacatgtgggccagcctgcctcactttacccaagtggatttggggagtagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgcttaatgcttacctgatggcaacttctggctctggaaccgctactctgccctgttcccagccacttcccaacctgattcaagcagggcccctccttccagcctgggcgacaaagcgagactccgtttccaaaaaaaannnnn

SEQ ID NO: 89981 - DNA, 4298 bp, Homo sapiens
  misc_feature (9)..(9): n is a, c, g, or t
  misc_feature (13)..(13): n is a, c, g, or t
  misc_feature (24)..(24): n is a, c, g, or t
  misc_feature (26)..(26): n is a, c, g, or t
  misc_feature (28)..(29): n is a, c, g, or t
  misc_feature (32)..(33): n is a, c, g, or t
  misc_feature (36)..(36): n is a, c, g, or t
  misc_feature (42)..(42): n is a, c, g, or t
  misc_feature (4294)..(4298): n is a, c, g, or t
gcagccagngagngcgctggtgcncntnnctnnttnttttgnttttctccggtcccctcctgcaggtgttgtttcggttgatcacctttgtcttgaatgcatttattcttcgcttcctgtcaaaggaaatcgttggcgtagtaaatgtaagagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgcgtatgattggcctttggagctacatgctccaacaaactgtatcttaattgttaactgttaataattatctggcccagaaaaagagatgcagtgattttacccttcacaggaatattgaacttcttctgtaaaagagagagagaaacctctctctttcatgcaccacatggaaacagagtgtggccctgaagttgtggctttctttgtgtcaaaactgtggtctgagtttttagagaaggaaaaatgctactcagtgagaaatccaagaaatgaaaccaggaaggttttcagatcacatttcccagagtgagttcgggagaatcttgcctgtcgtgatcacactgttccccgccgccccaggtcagcacatacttgacccagagtgggctctcaggatttgttgattgaagggtgggtgaaagctggctggagactcctggcctggccacctgcaagaggcggactttgaagaaaactgtgatccagttgagccactttgtccctgaggggaatgctgctttgcagctttctgtaacttctcacatgggaattgcactggtgacagataaggtttaacagatgtacttttttatcctcagaataagacaaggcaaactctatatggctagtattactgagtcaggtccctcccgttgacccattaattccagcattgatcaatacaaccaaattccagccccaggacaagagtggcaggcatgggggcctggtactccaggctacagtgtgagcccaggtgttctgcaccttgcagcctgcacactgcaggtgaaatcatgagcagtgttctggagtgtgaagtgtttttatttttttgttaatgtattaattccttttagatattaacccccctcagaactatatgcacaaactataacttggatgttaataatcctgtcactcagtgccccaaaccttctgtgtctacacctagagagagggccagtaagggcaactcctatcatgcattaaaatgcatgtatttaaatctgcttgcccagagccagtacccaggggctaaggattaagacctgtcagtacaccaagactggggcccagtcacctggcaggtttttatctactcagagggagaatgctttgcactaagtgggagaaaagcagctaaatgcaaggtgtcctgagcaattagaggacctccaaagcatggcctcagtcatgccttcatcgggcaaggtcaggccagctcagaaaaatggatggtcccatagggtcaagtggagcacacacggaaggcagtcctccttccctcccatgtcctttctctgtccctggcatccacagaaagggaccttcagtcctcatgagctgcttctctgcagctgctgatcaccctcccggaaccctgcacctatcccgtgcccacctgaccccagactcaagcatgatcctcattctacctgcctcggaatcacctggattgcaagtcagaacatggcttcccaggacccactccaggccttcagggtctgtgtctcccaggaggagggctctgagattggcttttctggcaagcccacgtggctttgatgccaccaaggttggcatgccccattgtcttccttcgtgacaggcccaggaccatcatgctcatgctcacagtgcctgttctctgctccaggaacagagctgctgctctacaagcagccttgtgactccggggtctctgggagcaggactccccaggcttgtgctctctcagcttgagagaggctctatgtctgaaggcagtgctcactctctcatccctcccctgctgttcgcccagtgctgctgtcagggccagctcctcttgaaagacagccagccgcaaaggcagcccagggcttcttccggtgtcctgcttccctgtatctagggagagttgtacatgtggctgcgtgttttcccaggactagccctgccgcctgggctgtcagcactttggcagcaggtcctctgtggttctctgcctctggtgcctccctaaagctcagctggacctgaccaggcctctggcatttcccctgctggaccccctagagccacagctgtgcctcagggagcttgcatacatgtgggccagcctgcctcactttacccaagtggatttggggagtagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgcttaatgcttacctgatggcaacttctggctctggaaccgctactctgccctgttcccagccacttcccaacctgattcaagcagggcccctccttccagcctgggcgacaaagcgagactccgtttccaaaaaaaannnnn

SEQ ID NO: 89982 - DNA, 3774 bp, Homo sapiens
  misc_feature (3770)..(3774): n is a, c, g, or t
atgaggccgtgggtttaatcggccgaggagattgttaccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgcgtatgattggcctttggagctacatgctccaacaaactgtatcttaattgttaactgttaataattatctggcccagaaaaagagatgcagtgattttacccttcacaggaatattgaacttcttctgtaaaagagagagagaaacctctctctttcatgcaccacatggaaacagagtgtggccctgaagttgtggctttctttgtgtcaaaactgtggtctgagtttttagagaaggaaaaatgctactcagtgagaaatccaagaaatgaaaccaggaaggttttcagatcacatttcccagagtgagttcgggagaatcttgcctgtcgtgatcacactgttccccgccgccccaggtcagcacatacttgacccagagtgggctctcaggatttgttgattgaagggtgggtgaaagctggctggagactcctggcctggccacctgcaagaggcggactttgaagaaaactgtgatccagttgagccactttgtccctgaggggaatgctgctttgcagctttctgtaacttctcacatgggaattgcactggtgacagataaggtttaacagatgtacttttttatcctcagaataagacaaggcaaactctatatggctagtattactgagtcaggtccctcccgttgacccattaattccagcattgatcaatacaaccaaattccagccccaggacaagagtggcaggcatgggggcctggtactccaggctacagtgtgagcccaggtgttctgcaccttgcagcctgcacactgcaggtgaaatcatgagcagtgttctggagtgtgaagtgtttttatttttttgttaatgtattaattccttttagatattaacccccctcagaactatatgcacaaactataacttggatgttaataatcctgtcactcagtgccccaaaccttctgtgtctacacctagagagagggccagtaagggcaactcctatcatgcattaaaatgcatgtatttaaatctgcttgcccagagccagtacccaggggctaaggattaagacctgtcagtacaccaagactggggcccagtcacctggcaggtttttatctactcagagggagaatgctttgcactaagtgggagaaaagcagctaaatgcaaggtgtcctgagcaattagaggacctccaaagcatggcctcagtcatgccttcatcgggcaaggtcaggccagctcagaaaaatggatggtcccatagggtcaagtggagcacacacggaaggcagtcctccttccctcccatgtcctttctctgtccctggcatccacagaaagggaccttcagtcctcatgagctgcttctctgcagctgctgatcaccctcccggaaccctgcacctatcccgtgcccacctgaccccagactcaagcatgatcctcattctacctgcctcggaatcacctggattgcaagtcagaacatggcttcccaggacccactccaggccttcagggtctgtgtctcccaggaggagggctctgagattggcttttctggcaagcccacgtggctttgatgccaccaaggttggcatgccccattgtcttccttcgtgacaggcccaggaccatcatgctcatgctcacagtgcctgttctctgctccaggaacagagctgctgctctacaagcagccttgtgactccggggtctctgggagcaggactccccaggcttgtgctctctcagcttgagagaggctctatgtctgaaggcagtgctcactctctcatccctcccctgctgttcgcccagtgctgctgtcagggccagctcctcttgaaagacagccagccgcaaaggcagcccagggcttcttccggtgtcctgcttccctgtatctagggagagttgtacatgtggctgcgtgttttcccaggactagccctgccgcctgggctgtcagcactttggcagcaggtcctctgtggttctctgcctctggtgcctccctaaagctcagctggacctgaccaggcctctggcatttcccctgctggaccccctagagccacagctgtgcctcagggagcttgcatacatgtgggccagcctgcctcactttacccaagtggatttggggagtagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgcttaatgcttacctgatggcaacttctggctctggaaccgctactctgccctgttcccagccacttcccaacctgattcaagcagggcccctccttccagcctgggcgacaaagcgagactccgtttccaaaaaaaannnnn

SEQ ID NO: 89983 - DNA, 299 bp, Homo sapiens
cattaggaagaacagccacattgttctcatttcagctaagtaaacacttctaacgtcatttattcttacgtatttttcctctttttctataggtgttgtttcggttgatcacctttgtcttgaatgcatttattcttcgcttcctgtcaaaggaaatcgttggcgtagtaaatgtaaggtaggaggagatgcaccctggcactgtcagagttcaccttcctagccaggctttcttcaaactctgtacctgtttgtcatccttggattctagaagcatggacctttatcagaagcagaat

SEQ ID NO: 89984 - DNA, 475 bp, Homo sapiens
tactgtgtgggcccccaagggacagcagcaattctttaggggtctcagtatatgagtcttgggcaggcccttacagactttggctttgtgtttagtaatgtaaattcttctccagtgtttgtgagatgccttctgtgtgcttagcattggatgaggattcagtggagactatccaagttgggatttagagaccagattgcatttgcctctcatgtagcattgcattcttagacttgcaacgcctgtgatgtttttgttttgttttgttttctcttctaggcgtttataaactggaaagaggctaaactgacttggagttttttcaaacagtctttcttgaaacagattttgacagaaggtaagtagacggtcactctgaatcgtcgggagaccatagtagaaggggatttcataggactgccaattacctgggtccagaccacctgtccagagcctctggggcagaagaatttca

SEQ ID NO: 89985 - DNA, 384 bp, Homo sapiens
gaggaaggaggtatagactgaggaacaggcactgacaatggtttctttccccaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgac

SEQ ID NO: 89986 - DNA, 854 bp, Homo sapiens
ggcggcatttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggggagcgatatgtggatgacctttttgaatgtcttggactttgggaccacggcggggttaaataacgaaaaacctgggccatggtggcgcaaataaaattccacgcaagaaggaaaggtaaatacgggaaagggcggagaggaagagccccttaagag

SEQ ID NO: 89987 - DNA, 4248 bp, Homo sapiens
  misc_feature (4244)..(4248): n is a, c, g, or t
ggcggcatttcctggtgtctgagcctggcgcggaggctatgggcagccaggaggtgctgggccacgcggcccggctggcctcctccggtctcctcctgcagagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgcgtatgattggcctttggagctacatgctccaacaaactgtatcttaattgttaactgttaataattatctggcccagaaaaagagatgcagtgattttacccttcacaggaatattgaacttcttctgtaaaagagagagagaaacctctctctttcatgcaccacatggaaacagagtgtggccctgaagttgtggctttctttgtgtcaaaactgtggtctgagtttttagagaaggaaaaatgctactcagtgagaaatccaagaaatgaaaccaggaaggttttcagatcacatttcccagagtgagttcgggagaatcttgcctgtcgtgatcacactgttccccgccgccccaggtcagcacatacttgacccagagtgggctctcaggatttgttgattgaagggtgggtgaaagctggctggagactcctggcctggccacctgcaagaggcggactttgaagaaaactgtgatccagttgagccactttgtccctgaggggaatgctgctttgcagctttctgtaacttctcacatgggaattgcactggtgacagataaggtttaacagatgtacttttttatcctcagaataagacaaggcaaactctatatggctagtattactgagtcaggtccctcccgttgacccattaattccagcattgatcaatacaaccaaattccagccccaggacaagagtggcaggcatgggggcctggtactccaggctacagtgtgagcccaggtgttctgcaccttgcagcctgcacactgcaggtgaaatcatgagcagtgttctggagtgtgaagtgtttttatttttttgttaatgtattaattccttttagatattaacccccctcagaactatatgcacaaactataacttggatgttaataatcctgtcactcagtgccccaaaccttctgtgtctacacctagagagagggccagtaagggcaactcctatcatgcattaaaatgcatgtatttaaatctgcttgcccagagccagtacccaggggctaaggattaagacctgtcagtacaccaagactggggcccagtcacctggcaggtttttatctactcagagggagaatgctttgcactaagtgggagaaaagcagctaaatgcaaggtgtcctgagcaattagaggacctccaaagcatggcctcagtcatgccttcatcgggcaaggtcaggccagctcagaaaaatggatggtcccatagggtcaagtggagcacacacggaaggcagtcctccttccctcccatgtcctttctctgtccctggcatccacagaaagggaccttcagtcctcatgagctgcttctctgcagctgctgatcaccctcccggaaccctgcacctatcccgtgcccacctgaccccagactcaagcatgatcctcattctacctgcctcggaatcacctggattgcaagtcagaacatggcttcccaggacccactccaggccttcagggtctgtgtctcccaggaggagggctctgagattggcttttctggcaagcccacgtggctttgatgccaccaaggttggcatgccccattgtcttccttcgtgacaggcccaggaccatcatgctcatgctcacagtgcctgttctctgctccaggaacagagctgctgctctacaagcagccttgtgactccggggtctctgggagcaggactccccaggcttgtgctctctcagcttgagagaggctctatgtctgaaggcagtgctcactctctcatccctcccctgctgttcgcccagtgctgctgtcagggccagctcctcttgaaagacagccagccgcaaaggcagcccagggcttcttccggtgtcctgcttccctgtatctagggagagttgtacatgtggctgcgtgttttcccaggactagccctgccgcctgggctgtcagcactttggcagcaggtcctctgtggttctctgcctctggtgcctccctaaagctcagctggacctgaccaggcctctggcatttcccctgctggaccccctagagccacagctgtgcctcagggagcttgcatacatgtgggccagcctgcctcactttacccaagtggatttggggagtagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgcttaatgcttacctgatggcaacttctggctctggaaccgctactctgccctgttcccagccacttcccaacctgattcaagcagggcccctccttccagcctgggcgacaaagcgagactccgtttccaaaaaaaannnnn

SEQ ID NO: 89988 - DNA, 3448 bp, Homo sapiens
  misc_feature (12)..(12): n is a, c, g, or t
  misc_feature (3444)..(3448): n is a, c, g, or t
ttaactgtccanagtgccacatgcctacgattgaaatgaaaactctattgttacctctgagttgtgtccacggaaaatgctatccagcagatcatttaggaaaaataattctatttttagcttttcatttctcagctgtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgcgtatgattggcctttggagctacatgctccaacaaactgtatcttaattgttaactgttaataattatctggcccagaaaaagagatgcagtgattttacccttcacaggaatattgaacttcttctgtaaaagagagagagaaacctctctctttcatgcaccacatggaaacagagtgtggccctgaagttgtggctttctttgtgtcaaaactgtggtctgagtttttagagaaggaaaaatgctactcagtgagaaatccaagaaatgaaaccaggaaggttttcagatcacatttcccagagtgagttcgggagaatcttgcctgtcgtgatcacactgttccccgccgccccaggtcagcacatacttgacccagagtgggctctcaggatttgttgattgaagggtgggtgaaagctggctggagactcctggcctggccacctgcaagaggcggactttgaagaaaactgtgatccagttgagccactttgtccctgaggggaatgctgctttgcagctttctgtaacttctcacatgggaattgcactggtgacagataaggtttaacagatgtacttttttatcctcagaataagacaaggcaaactctatatggctagtattactgagtcaggtccctcccgttgacccattaattccagcattgatcaatacaaccaaattccagccccaggacaagagtggcaggcatgggggcctggtactccaggctacagtgtgagcccaggtgttctgcaccttgcagcctgcacactgcaggtgaaatcatgagcagtgttctggagtgtgaagtgtttttatttttttgttaatgtattaattccttttagatattaacccccctcagaactatatgcacaaactataacttggatgttaataatcctgtcactcagtgccccaaaccttctgtgtctacacctagagagagggccagtaagggcaactcctatcatgcattaaaatgcatgtatttaaatctgcttgcccagagccagtacccaggggctaaggattaagacctgtcagtacaccaagactggggcccagtcacctggcaggtttttatctactcagagggagaatgctttgcactaagtgggagaaaagcagctaaatgcaaggtgtcctgagcaattagaggacctccaaagcatggcctcagtcatgccttcatcgggcaaggtcaggccagctcagaaaaatggatggtcccatagggtcaagtggagcacacacggaaggcagtcctccttccctcccatgtcctttctctgtccctggcatccacagaaagggaccttcagtcctcatgagctgcttctctgcagctgctgatcaccctcccggaaccctgcacctatcccgtgcccacctgaccccagactcaagcatgatcctcattctacctgcctcggaatcacctggattgcaagtcagaacatggcttcccaggacccactccaggccttcagggtctgtgtctcccaggaggagggctctgagattggcttttctggcaagcccacgtggctttgatgccaccaaggttggcatgccccattgtcttccttcgtgacaggcccaggaccatcatgctcatgctcacagtgcctgttctctgctccaggaacagagctgctgctctacaagcagccttgtgactccggggtctctgggagcaggactccccaggcttgtgctctctcagcttgagagaggctctatgtctgaaggcagtgctcactctctcatccctcccctgctgttcgcccagtgctgctgtcagggccagctcctcttgaaagacagccagccgcaaaggcagcccagggcttcttccggtgtcctgcttccctgtatctagggagagttgtacatgtggctgcgtgttttcccaggactagccctgccgcctgggctgtcagcactttggcagcaggtcctctgtggttctctgcctctggtgcctccctaaagctcagctggacctgaccaggcctctggcatttcccctgctggaccccctagagccacagctgtgcctcagggagcttgcatacatgtgggccagcctgcctcactttacccaagtggatttggggagtagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgcttaatgcttacctgatggcaacttctggctctggaaccgctactctgccctgttcccagccacttcccaacctgattcaagcagggcccctccttccagcctgggcgacaaagcgagactccgtttccaaaaaaaannnnn

SEQ ID NO: 89989 - DNA, 391 bp, Homo sapiens
tccttcgacctattttatttacagacagggtcttgctctttcatccagcctagagtacagtggatgatcataactaactgtagccttgaactcctgggttcaagagatcctcctgtctcactctcctgagtagctagaaccacaggtgtgtgccaccacgccaggctattaaaaaaaaacaaagacaaagacaaaaacaaaaacaaaacttttttgtagagacagggtctcactatgcagccaggctggtctcaaattcctggcctcaagtgagcctcccacctcatccttccaaagcactgggattacagaagtgaaccaccacgcctggcctactttttttttttttttgagatagtcttgctctattacccaggctggtgtgcagtcg

SEQ ID NO: 89990 - DNA, 414 bp, Homo sapiens
agcctgggcaacaagagtgaaactctgtctcaaaatatataaaagacaacaatactctccaaacggatcaaaaaactcaatgcaatccccatcaaaattccagctagtgtttttgcagaaattgacaacctgatcctaaaattcacaaggaaacacaaaggacccagattgtttgacccagggtcaaacagtcttttaaaaagaagaacaaattagaggattcatacttcctgatttcaaaacttcagggctacagtgatgaagacagcggggcactgtcagaaggacacgcagagaccggtgggttcactcagagtccggaaataaacccacacgcctgtgggcaactgatttcaacaaggatgtcagatcactcaatggggaaagaacagtcttttcaacaaggggtgcgga

SEQ ID NO: 89991 - DNA, 528 bp, Homo sapiens
gacccaaggcaatgtggagacagagagctgacagccctcctatcatccccatcagtgaagccaccttggtccatccagagcaggccatcaaccagctgagtcccactgagggacccccatcaatgccaggaaagcagaacgcccagccagctgagccctgcctaaacggctgactgcaaagttatgagatagaataaagaggttgtcatttatgccactgagcttggggcagttagttttgcaacaatagagaactgacacactaactgttctgcctaaagaagagccatggaccatatgtggtctctgagacactgtgactctgagtcatggagctccaaaatcaacaagggtcaggcccttctaatttaactctcactctggcttgataaaacccagatagatgaggctaagacaggggtgtaagactaaaaatcccaaattaattgacttaaaaatttcatttcatccccactgaaatgtactcctaaatgccccctaagggaaggaaaaatggaaaaaattaaa

SEQ ID NO: 89992 - DNA, 295 bp, Homo sapiens
tttgtgtccatactagagctctctgagcttttccggcaccagaagagcaccagaatgatgtgtttagggggcactgaagacatgaaaattctcttcctgtaacgtaatgaaaatttaactattgtataaatattttaagtacaggaagtgaagcagagctttggagaggtgtcctttctgagcaaaacctgcgtggaactggagatttaaattaaagtaacagaaaacaataaaaaaatttggatgattactccttcctttgattttcatctcacagaatgggaattcatataat

SEQ ID NO: 89993 - DNA, 437 bp, Homo sapiens
gtccgacgatcaggcgaccccaaaatgaccaaggggaaatacactttttaggaggatggggttgcagctttaccaaggaggatagaccgtaaaattactatcctggagatacttctttagggatttggagtaaaaataatatttttaagattcgtggacgttaaaagtaccctagcttgctttctatgttatgcctgtcgcctcaaaagaagctctcctgtggaacccccacctcacataggaaaactcagcagggaatgggctcagtgattcttacctattggaactagatgacacaggccaaggagcccggagcatttgtgaaactccagccagcaagttgcatcaaggttttagttagcagagcttggcattgtgcctttatcacatgtctggatgagatgtgtgctggtggtaaatgtgtcctactgggcccc

SEQ ID NO: 89994 - DNA, 2337 bp, Homo sapiens
agcggaagtgggcagagcggggaaggctgagtccacactgcaagtccagagagcagggaactaccttgagtattctactcaaacttatgtctcagagttccccaatttcccaagaagggagagatagaggccacaatccaggggccatctcttaaggtaccaataattttgcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaagatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgtttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcatggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatcttcacttgtggaaatgagttttagggaagggattgagtcttggaacatgactttcatccagatatctaacgacataatagaatgcataattagctctgtgcctcatgcattattgccttctaaaattacataaatgattaatgggcagacataaaagtgggctttaaagaaatctagaaataataaaaacagatgctgaaaaag

SEQ ID NO: 89995 - DNA, 2437 bp, Homo sapiens
agcggaagtgggcagagcggggaaggctgagtccacactgcaagtccagagagcagggaactaccttgagtattctactcaaacttatgtctcagagttccccaatttcccaagaagggagagatagaggccacaatccaggggccatctcttaaggtaccaataattttgcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaaaggccaggcgcggtggctcacgcctgtaatcccagcacttcgggaggccgaggtgagcggatcttgaggtcaggagattgagaccatcctggccaacacggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgtttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcatggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatcttcacttgtggaaatgagttttagggaagggattgagtcttggaacatgactttcatccagatatctaacgacataatagaatgcataattagctctgtgcctcatgcattattgccttctaaaattacataaatgattaatgggcagacataaaagtgggctttaaagaaatctagaaataataaaaacagatgctgaaaaag

SEQ ID NO: 89996 - DNA, 2106 bp, Homo sapiens
agcggaagtgggcagagcggggaaggctgagtccacactgcaagtccagagagcagggaactaccttgagtattctactcaaacttatgtctcagagttccccaatttcccaagaagggagagatagaggccacaatccaggggccatctcttaaggtaccaataattttgcaggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgtttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcatggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatcttcacttgtggaaatgagttttagggaagggattgagtcttggaacatgactttcatccagatatctaacgacataatagaatgcataattagctctgtgcctcatgcattattgccttctaaaattacataaatgattaatgggcagacataaaagtgggctttaaagaaatctagaaataataaaaacagatgctgaaaaag

SEQ ID NO: 89997 - DNA, 1188 bp, Homo sapiens
agcggaagtgggcagagcggggaaggctgagtccacactgcaagtccagagagcagggaactaccttgagtattctactcaaacttatgtctcagagttccccaatttcccaagaagggagagatagaggccacaatccaggggccatctcttaaggtaccaataattttgcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaagtgagttctttcccccaaatatttcctttgttttgttttgtggtattttgacttctctaatttttttttaaggatgagaaatttttataaactttccagtaactacttaagagaaaacttttgcttggcaaaagtgtatgccttttgaagtttcttagccattttagctaaaggttatcaaattttatatgctgagcttttcagatttctcattcttataacttgcatgtggaggtaacataggggccagataactccttggaattgcctcttgagtttttctaatggtcttaatgtggggtatagctttattgttgtaaaaagaggaagaagaggagggctcttgagattttatttggcttaatttatttgaatgaataacattatcactgagcatattttatgactagatttatatttcaagagcacattttgaagtcacttacaggttttaagtaaaaggagttaatgagattcctgctattttcaagaaaaatctgcctactttccagaagtgggcatacaaaaattcataatctttaattttctaaggttaaattaaaatatctgtgtttccagcccacagaaatatataatagactatatcaatctaaagtgctacttcttgaaacagaggtagtgttattcaggcaaaaagcatacatcccatatgtgttaatgctttctctctcactattttagtcatatcctctttggtacctatcattcatttgaaaaccaaatgcagctcctcagctgtcatttcagactttagaaaattgg

SEQ ID NO: 89998 - DNA, 2213 bp, Homo sapiens
atttgttactcatagttttaagtaaaaattgacaaatagtgctttttcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaagatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgtttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcatggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatcttcacttgtggaaatgagttttagggaagggattgagtcttggaacatgactttcatccagatatctaacgacataatagaatgcataattagctctgtgcctcatgcattattgccttctaaaattacataaatgattaatgggcagacataaaagtgggctttaaagaaatctagaaataataaaaacagatgctgaaaaag

SEQ ID NO: 89999 - DNA, 447 bp, Homo sapiens
ctgtaacaaatacggccaccggacaaaggaccttgtgtgtctttttaaaggaacaatttggagcttttctgagctgcgtgaccacgggcacatcacgtagctccttgaagccttagtttcctcttctgtaaaatgggcacagtcatgataaccttctaggttgctggggtcattcattaagttgatgtcagcagagcatttatcacagagctggcttattgaagctgccatcgtgatctgatgacatttagggtcctctgcttaaagccctccaagggctcccccctcactcgggtaaaatcaccagaaaggccatgcaggacacacccccgctcctgctggcattaggtctgccccctccaccccggtcttcatttcctatgactgctgtaatacatgactgcagacttagtgccttagaatgacacatatttattcttttaaggt

SEQ ID NO: 90000 - DNA, 338 bp, Homo sapiens
ttctcttgtgttctcatgttccatcctcatacagattccaggacccaggtcagttgatacccacatatcacagaagaggacactgagcctggagaaggaaggcggcttgtcccaggtcacatagctagagaccaaactagatggaaagtgccagtctttctctgacagcacatgacccaggagaggctctgccacatatcctgatgggctgccccatgggagctaccagggcagatctgagagttctcctgggctccccccacattacacagctgtttcccagggggcttcctcccagccctttgatgtgaatgtagccacattgccccctcacctga

SEQ ID NO: 90001 - DNA, 1421 bp, Homo sapiens
aagccgcggcggccgccacttcctttccgcctcgccggtagggctcgcccaccgagtgaagccggccgcggccaatcgcggcgcccgcctgctcccagtggcacggcctgggggccggcgtccgccggggctggggaagccgttccaagttccaagggtcgcgggtgtaactcatgcccctcccagcacgcgccggcgtctccccttggcccccggtctgggtgcgtttgccaccctctcctccttgttccctaagaagcgggggaggggaaggaggcgggcagcctgggcagggcgccagagccgtggtcgggcaccaggtgaaacgcccgggtcagtctgtgtaggccggacccttggcgctcggctgcggatgtgatcccggggactggcggccgaggtagctcagaagagcgaggtggctttcgctcgtttctgacccgctactgtctgaaacttggggacatattgcccgccccctccctcttcaacctcctccctccggttgctccttgtccttggttatggaaggaaaaaactcagttgttctaaatgaggaaaagtggtgctggcattcgtcttcagccaccggcctccttatggctgtgactcggtctgcttttgatgaatggccaggaggtatggaggatagttagatttcctgttgtggattttcaggcatcaccgagactcctgtcaagcctgcagtcatttactagttttcatatcgactgcaggttctctttgagcagttcagtttttggtgcttaagggcaggtgcacaacggggtctggggttagaccaggcggtggatagtcttgatgctaggcagatgcagttatccctaccaggcccagagggtgactctgtttaacttcaccacgcacgcagattcaggattctctgatttccccaactttcctttattcttcttttagtgggagaaggggcaaaagtagaaacctaaaaaatcctgggaaaaggagccttttctgaggaaacttcagcagatgaaatatttaagacttgaactgggatctctagggggaacgttggaacatctattgattgatgtgtcaaagtccggaatttcactgtaattagtgaacgattataacttgtaactttgtctgttatgtaagaaattacattttggtctcttagatccaagagttcttgtctgttacgatttgtaactgcttgttaaaattaaacatttacatatttcattctcagtgagttgtcatttttttgttagagaaagttccagttatttcagatttacttacctgtaaaaatgtcagcataatcaaaagtaaggatctgtagtcaaactggaagcaaattatggcaaacacatgcgtgccatgaagttctgacagccttatgaacaatggtcccacttttatcccactttctg

SEQ ID NO: 90002 - DNA, 612 bp, Homo sapiens
ggctggaggagtgtggcgtgggagcggcgtattgatctagaaaccaaaaccccggggcctgacaaaaacttagaggcctggaggcagaagaacaaaatcccacactccctctggaggctctgggggagggcccttccctgccccttcctgcgtctggcggccccgaatccctggtgtttcttgaccactcgcgacctcctccgctttcgtatgcccgcccccatccgggtgtctgtcctttctgtctcttacaaggacactctcactggacttgaggcccctcaaatccaggatggcctcgtccccatccttaccattatgagatcaacaaagacctgtttccgaatgagatcacctttgaagctccaggcaatatgaatttgagggggacaatattcagctactacggagggcagacgcactcacgggagatgagaaacgcgggtgggcagggggtcggtgaggcccaggcatactggctgagggcacgactaggcgggattccaggacacccagtgcctggaagtgaccgcagcccaggaccctctgccggctgcccacggagctgcagcggcctgccagggagtggccctgctggggccgcggccgcat

SEQ ID NO: 90003 - DNA, 149 bp, Homo sapiens
actgcactccagcctgggcaaaagggcgagactccatcttaaaaaaaaaaaaaagttgcttctctgaaaaattcaacataattcacaaaactttagctagaatgaccaagaaaaagagaaaaatgaccccacttaccaaaatttattag

SEQ ID NO: 90004 - DNA, 192 bp, Homo sapiens
ggagaaggagatgggggccctaggggataatggagagagaggtcgggtctcccaaccaaggaaactggaaaagagtgccaccctcgcccgcgtcgcctgtggcctcttccacggactgagagaagggatggaaccctagaggaaagaagggagtctgggtctcgcttccccggggagaagatcccttccctg

SEQ ID NO: 90005 - DNA, 1057 bp, Homo sapiens
taaatgcaccaatatattttcatctaaatattgcaggtttggctacagaccttgatgtgtgtataatgaaacttgaaaggtctcagaggaaggaacagtggtgtagtggacgcaggggacagctgttccctgttgggagacaattctgcatgggccctttgtatttctgcacatcttgcaagtagagacactaactgcatttgtgctggattagattttcaagtaaactgctttggaagatgatagtgtctccctctatagcatgagcaggtttgtttgctcttaaacatgataataacttctgctggggcaaaggtaaggccgacttaactgaccattataaaagattcatgttggggattcgtttttgtaacacaacccgtgtgtgtgtgtgggtatgtgtgtgtgtaagtgtgttcgtgcgtgcttgcaggtgtcatctgccccccttcttatttttctatgggaattgggaatctggtgcaaatgctgatactgtagctactgctattgctgtgagtaataaactaggctttgtctctaacccaagagtcttgtgtcttttgccagcattcatgaaactgtggtagactaatttgttaacctgcaaataggggaaaaatctcacatccttcgcaggtcttgacatgagtcaagtgacaaaccaaaaaatggggactttttagttgagaaagacaaagaccaaaggggtagaggataaggctgaagtatataaaatcaacaaaagtaaacttggttgtattcaccagtcttgaatatcaagtgaagggatgaatccctgatgtttgagagaggtaagtttatgtcaatagaaaggaatttcttcacatacaggatactaaccttatagaacttaccatctcaataaatggtgctggctgaaactacaaattattttataaaaggcctcactaaagtgatggatgacaaacctagaatgcccagttcaatacgtattggatgaccgagtgtttgccaagtgaccatctataagatgatctcattatctgtgtcagagaagaactactgggaaaaa

SEQ ID NO: 90006 - DNA, 427 bp, Homo sapiens
tccgggtccccaggctcaactatcagccgccttctcatcccaagggctgtcaccaccagaaatttaacatgctgttagtgcatgcaaaaaaaagcccagtaattgtagggctcatcagtacattgttaattgatcctcatttcctattattttacctcaaagccaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcactaaaatgcacttccgtaca

SEQ ID NO: 90007 - DNA, 179 bp, Homo sapiens
gaagaagaccctgtctccaaacaaataataataaatcaagacctaaaggacaagaagacgtttgccatttgcagagctggagaaaagcatggtggcacaggaagtggcatgtgcaaaggtcctggggcagggaagaagtcagcattcttccctcattctcgtctttgcaaaggtcctgg

SEQ ID NO: 90008 - DNA, 148 bp, Homo sapiens
cttctctgacatcatctcctaccactttctccccgactcactctgctccacccaaagtggacttcttgatgttgcccaagccaggaatgctcccacctcggcatctctgcgctggctgctccctttgcctagactgtctgtgttcccc

SEQ ID NO: 90009 - DNA, 389 bp, Homo sapiens
ttttttgtagttttagtagagacggggtttcaccatgttggccaggctggtcttgaactcctgacctcaggtgatctgcccgccttggccttctaaagtgctgggattataggtttgagccaccgtgcccggcccttttaagtcttattgcagtggttattaaatacagttagtaaatacatttgtctttggtttcacatagtataaaaaatactaacagttttattcatcagtagttctgtgagcctcattaatattttgatttattttatcttatgtagtgtttactttttgttcatagatattgaagcaatgggaaataatttctaagtaactacatgtatcaggtaatttgaagacattgataatgaaagtggtatatgtgtacc

SEQ ID NO: 90010 - DNA, 279 bp, Homo sapiens
tctgaataaaatataagggtaagtcttcatgaccctggatatgtcaatgaattcttagatttgataacaaatgcatgaggaattttttttaaatagataaatagttcttcataaaaattaaaaacttttggccaggcatggtggctcacacctgtaatcccagcactttgggaggccgaggtgggcagattacctgaggtcaggaattcaagactagcctggccaacatggtgaaaccccatctctactaaaaatacaaaaattaggcaggtgtggtgg

SEQ ID NO: 90011 - DNA, 597 bp, Homo sapiens
tagagacagggtctcactatgttgcccagactagagtgcagtggctattcataggtgctatcccactactgatcagcaagggagttttgacctgctccatttctgacctgggtcacttcatccctccttaggcaacctggtggtcccccactcctgagaggttatcatattgatgctggtttggacacccaattggcatagcacactactgcccagaacccctgggttcaagccatcctcacacctcagcctcctgagtagttgggactacaggcatgaaccaccgtgcctagcgaatttcctccttttataaagacaccaatcatattggatcaaggtccactctactgacctcattttagcttgattagctctgtagagatcccatctctaaataaggtcacaatctgaggtgctggggattaggacttcaacatatgaatttgaggacagagataattcaatgcacaataatcagaaaatgtgcatatttatgagttcataattatacagaaatgcctactttatcacgtttaatagggggaaagggtgggtatcaatgtatgtatatggtaagacttctattttttctttttt

SEQ ID NO: 90012 - DNA, 246 bp, Homo sapiens
taaaatgatgctaagatttacatttattaacatggaaagatgccaaaaatattgctgcttaggaaaaaattaaaagcatggttccatgtgcataatataaaactgcatatagcatggcattggcggaaaataaatacccatgacatgtaacactctgggtatacacagcactggatggcctacttatagataaacgaatgctccaggcttatgttccacccctactctcattgtatctttcttctt

SEQ ID NO: 90013 - DNA, 390 bp, Homo sapiens
tggggccccaacaccctgcagtacctaaactgccctgatggttggttcacacagaccacatgatggtgagaggccctcacagcactgaatccagaaacaggagccagagaacctagggactgtcataccattttgaaaagaggcaccactctcgctgaacttcttttctctgccacctccctataaccttgatagtgagtgctagtgtcctggattctgatcagctgtaagcatcagcctccctataaccttgatagtaagtgctagtgtcctgggttctgatcagctgtaagcatcagcctccctataaccttgatagtaagtgctagtgtcctgggttctgatcagctgtaagcatcagccacaaaggactatgcccttgacaggctt

SEQ ID NO: 90014 - DNA, 3142 bp, Homo sapiens
  misc_feature (2057)..(2057): n is a, c, g, or t
agtttcactttcccttttgtaacgtcagctgaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggnggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaatttttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacata

SEQ ID NO: 90015 - DNA, 3095 bp, Homo sapiens
  misc_feature (2010)..(2010): n is a, c, g, or t
agtttcactttcccttttgtaacgtcagctgaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagacgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggnggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaatttttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacata

SEQ ID NO: 90016 - DNA, 3088 bp, Homo sapiens
  misc_feature (2003)..(2003): n is a, c, g, or t
agtttcactttcccttttgtaacgtcagctgaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggnggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaatttttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacata

SEQ ID NO: 90017 - DNA, 3506 bp, Homo sapiens
  misc_feature (2057)..(2057): n is a, c, g, or t
agtttcactttcccttttgtaacgtcagctgaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggnggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaatttttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacataaagcagtgttctggttcatctggaattttgctgtactttaaatctttcagactcagctactgataaatgaaacgttacacaggtgtgaaccaaatccaaataacctcgactggtctactatcataatcacctgaacagaacaaaactttttcctcagctttaagagtccagggcttcggataacagctgccatctgccacctgctaccattgacctacgtgaacacagacattctgtctccaccttgatggtgggtgggctgctccccttttctttgttaaattttgtgctttcatcacattttctctattctgacctctgttatgagaaataaaagtcactgattccattttaaaaaaaaaaa

SEQ ID NO: 90018 - DNA, 3093 bp, Homo sapiens
  misc_feature (2008)..(2008): n is a, c, g, or t
agtttcactttcccttttgtaacgtcagctgaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggnggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaatttttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacata

SEQ ID NO: 90019 - DNA, 850 bp, Homo sapiens
ggaggcctcacaatcatggcagaaggcaaaaggcacatgttacatggtggcagacaagagagaatgggagtcaagtgaaaggggaaacccctcatgaaatcatcatgtcgtgagatttactcactaccacaagaaccgtatggggagaaccacccccatgatttaattatctaccagtaggtcccttccacaacacgtgggaattatgggagctacaattcaaggtgaggtttgggtggggacacagccaaaccataacagcaaccaaataacctaaattccaaaaaggacaaccctccccacacaaccccctcaaaggcatagatcatatgcattgtttcacttttggcagaacacaagagaaagagacggctactgtaaaagtgagtaagaggaaaactcctagagttttaactaaaaggcctttaactgcaaggccaactatggcctaatttggaatgtctgggggcctcagacagaatgggagtttacactttcttgcaaacacttttccttggggctccacagagtactcccaattaagaggaggcaaaagcaggagactacagaaagccatctctgtggtgtagggatgaaggaagtgatgatctgcagctgcagagagagaatgatgcagagaggcctttgtgcctgggagacaggacaaaggccttcccatttactcagacccttctcctttaagcctcaaaccagtgggggaggggcagaaaaccttctgatttcatacgtttctgaagggagattagaagtcaaacccctgtgctgcttagaggaggaaccctcctgtccccaggatgcaggcagagactcattgatgccggggaaaggg

SEQ ID NO: 90020 - DNA, 138 bp, Homo sapiens
gggatggctgaaaaacaacctttagcttgagtttctagatatgacttctaaagccctatcagagaactgggctgctcaaagagctgcagctgctgccaccattaggaagcatcaccaccctgcacctctgccacagcc

SEQ ID NO: 90021 - DNA, 487 bp, Homo sapiens
tgtattaaatcgagctcggtaccgtctgagcagctggaaagggattaaaaagctgtttggaagctctgagcgtaaagactttgagctttgctttgggatgatcggcagaacataaccctcttccccttgccatgtcactgcttttaggaaagcctcgagactggtcaccttgcccagaggagtgtttttcagcctgcttaggaggaaaggtggctgggagctgggtagcgaaaggggcggctgcgggggcggcgtcagcattcacttaatctttgtctttttggtgcagtaccagtgccctccactgagctgaccaggccttattctagagatcctcttgttttactgtcttcaaacaactcaccttctctgagtatgaggagggaatctgggatctaactcattggaaaccagatttcaccctgtcctcctccttttaatgttcttctgtaactccagttcctccagttcccagcttgctccagta

SEQ ID NO: 90022 - DNA, 494 bp, Homo sapiens
  misc_feature (95)..(95): n is a, c, g, or t
  misc_feature (256)..(256): n is a, c, g, or t
  misc_feature (346)..(346): n is a, c, g, or t
  misc_feature (374)..(374): n is a, c, g, or t
  misc_feature (392)..(392): n is a, c, g, or t
  misc_feature (435)..(435): n is a, c, g, or t
  misc_feature (455)..(455): n is a, c, g, or t
agtagatatacattgcataggcagcaacagcaatattctggtggggctggatccctggctggcccttcagggggcttcttccctggcaaccttgntcttcgaagcctcggacctgattcaaggtttttacaggaaaggcagctgcagctgcagcagcaacgtatgcagctggcccagaaactgcagcagcagcagcagcagcaacagcagcagcagcaccttctaggacaggtggcaatccagcagcaacagcagnagggtcctggagtacagacaaaccaagttctgggtcccaagccccagggtcttatgcctcccagcagccaccaaggtctcctggtccagnaggtgtcccctcaacccaccccaggggncccagggtatgcttgggncctgccccaggttggcttgttgttgcagcagcagcaccctggngctttggggccccccagggncctcacaggacaggtgttttatgacccagtcccgggtgg

SEQ ID NO: 90023 - DNA, 605 bp, Homo sapiens
cagcctaggcagcatagtgagaccccatctctacaaaaaaaaattagctgggcgtggttcgcatgcctgtagtcccagctactcaggagtctgaagtggaagatcacttgagcctgagaagtctaggctacagtgtgccatgatcttgccactgcactccagcctgggcaatagagcgagaccctgtcataaaaaatacttttactaagcattttactcgatttttatttttcacctccacctcctaccacatgtattaagaaaatgggtgacatgttggtatattgcccactcaattgcctaaactttcttctgcttaatagtttcttttctggcaagaagtcttagagacatggcttatggacggcaattttcaaaatctgggtttcttatctgtgagatttaagcaaagccactgatagcttggtatgtgaacctcctaaagtattattaatgaatggttggtattaagatgagtagttggttccagacatctactagactgaattgaagtatatcttacatatgaagtatatcttaatgagaggttcatcagaattgtgagaaataaatttttaactatacatgccttatagattagaaac

SEQ ID NO: 90024 - DNA, 90 bp, Homo sapiens
gatctcaaagcaaatctgtattttaatctctcaggtgttcactagtattaccagtgactagtggaaataataaaaggaaatcttgttcat

SEQ ID NO: 90025 - DNA, 297 bp, Homo sapiens
ctgcatccacccccaatgatgaagacattttcaatgtaagcaaaagtcctggagatttccccacatcatatacatggggacataggaactaacatttgtcatatatttatattttcctttccaaagcagatcaaccccaagttaccttcccttagctctcgttttctgcctctctttgcaaatatcacttcattaaaaattgtgaacattctctttgccttcccttatgggcttcctgtttgaacaccacatccagggcaccctgggaactgaaccatctccttttctttttctttt

SEQ ID NO: 90026 - DNA, 436 bp, Homo sapiens
aataatttttcaattattaaaaaataaaatttcaaaaatgaaagattttgaatattaaacatatacctattattcctatagagatgatagatttagaatacataaagtgaaatatagtttccctttaggtagtaaataagtgtgtcttaaggtgattgcaataaaagtatagttatcatgatgtaaatatatcccaaaataataaattcataaatgatttttatggtgattagaaactgattttattcagtcagttccctttgtattctaggcaaagtgcctatttctacacatgggatcacattcattcctcaatcaactttgagggggaagatagaatattctccacatgaaaaataaagaaactgatggtagagtgacttgttccccattgattctccagggattaatgtgattaatgtgatacatggcaggt

SEQ ID NO: 90027 - DNA, 1241 bp, Homo sapiens
gaaaatacaggcagagattctgtgatgcagttttgaggcagaatagctttctttagggaaaccttagtctttgctcttaaggccttcaactgattgcatgaaactcatccacattatagagattaatctcctttgctcgaagtctatttaaatattagtcacatctaaaacatacttttacagcaacatctagactggtgtttgaccaaacaactgggcatcatagctgacacataaaattaaccatcacaaccatgttctaggcactgttcctcactgcctgagaagacaccgttatgtttattagggtttttgagttttatccacagcttttggttatctgcaaccatgtctcccaccattaacatagttcacactgagatgaggattccctatttaacacttggtcccaacttcttcacagtccatctggttttgtagagggaacataactggacattctggtcaggttaggtgaggtcaggccttcaggacgctattttcactgagttgctttataaggcacattatgcaaaattccatcagctcttctgttcactacattcactgttgaaattctaagagtgagactgctgtctcacaccaaagccagtgggtactatcttcagtaggcacgcagcatcatgtttgtatttgatccagctagatgacatgtaagagaaaactttattgtgggactctgtaaagtgtgacattcgtttgtgactcaatttgctcatgtatttgttcctgggagttcattacatagctaacttccagctgctttcaatttacatcataaaagaaatgcatcatattcttctcagtgtcctggtagtgcattttcctttagtttttcagtgaattctgttgtaagtaaaatggataagattgttcattattttggattattttgctgaagatgaccagctctgagatgtgaggagtaaataagaaagtaacagtagaatctggaatatcttttaaaaattaagacatcatttttaacagcagagtagccttaaatgacctgattccacagaggagccaggaaacagtatgaaactacaaatttattttgtagaaatatggaaaccttaatactattaagatgtaaatcttaatactattaagatgcaaatcttaatactattaagatgcaaatcttaatagtatttttataaagtgaaaacaatatgatcacttaattactcaagtggagctgaagaaaatttcagaga

SEQ ID NO: 90028 - DNA, 1218 bp, Homo sapiens
gaaaatacaggcagagattctgtgatgcagttttgaggcagaatagctttctttagggaaaccttagtctttgctcttaaggccttcaactgattgcatgaaactcatccacattatagagattaatctcctttgctcgaagtctatttaaatattagtcacatctaaaacatacttttacagcaacatctagactggtgtttgaccaaacaactgggcatcatagctgacacataaaattaaccatcacaaccatgttctaggcactgttcctcactgcctgagaagacaccgttatgtttattagggtttttgagttttatccacagcttttggttatctgcaaccatgtctcccaccattaacatagttcacactgagatgaggattccctatttaacacttggtcccaacttcttcacagtccatctggttttgtagagggaacataactggacattctggtcaggttaggtgaggtcaggccttcaggacgctattttcactgagttgctttataaggcacattatgcaaaattccatcagctcttctgttcactacattcactgttgaaattctaagagtgagactgctgtctcacaccaaagccagtgggtactatcttcagtaggcacgcagcatcatgtttgtatttgatccagctagatgacatgtaagagaaaactttattgtgggactctgtaaagtgtgacattcgtttgtgactcaatttgctcatgtatttgttcctgggagttcattacatagctaacttccagctgctttcaatttacatcataaaagaaatgcatcatattcttctcagtgtcctggtagtgcattttcctttagtttttcagtgaattctgttgtaagtaaaatggataagattgttcattattttggattattttgctgaagatgaccagctctgagatgtgaggagtaaataagaaagtaacagtagaatctggaatatcttttaaaaattaagacatcatttttaacagcagagtagccttaaatgacctgattccacagaggagccaggaaacagtatgaaactacaaatttattttgtagaaatatggaaaccttaatactattaagatgcaaatcttaatactattaagatgcaaatcttaatagtatttttataaagtgaaaacaatatgatcacttaattactcaagtggagctgaagaaaatttcagaga

SEQ ID NO: 90029 - DNA, 420 bp, Homo sapiens
gcatgatggtggatgcctgtaatcccagctacctgggaggatgaggcacaagaattccttgaactgaagaagtggagattgcaatgagccaagatcacgccactgcactccagcctaggtgacaaagtgagactccatctcaaaaaaaagaaagagagagagacagtgtttttctatgttgcccaggttcatctccaactcctggcctcaagtgatcctcccacctccacctcccagagagcaagaattacaggcatgggccacctcacccactctataagacatttcttaaaaagataaggcaaaaaaaaaaatatggcaaaatatggatagttgttaaagttgagtaatgggtgcttgcaagttttttacactctcttatgtatgcttggaaattttcaatatcaaaagttaattaaa

SEQ ID NO: 90030 - DNA, 160 bp, Homo sapiens
gatcgtaacaatgccaagaagacacaagaatatgagaaaggaattcctagaaaaaaggcaaaggtttcaatgactaagctaattttttctaagtctactgataacatactccctaccccatcctccattaataaaagaatggttgttgtattgtattatg

SEQ ID NO: 90031 - DNA, 531 bp, Homo sapiens
cactttttggctattatgaatattgctgctgtgaacatttgtgtaggtagtattttgtgtggaaatgttttcttttgggtatgtacctgggactggattgctgggttatatggcaattgggtttaaccggttttccaaagagaccataccgttttacattctcatcagcaatgtgttgagagtcccaatttctctctagcgccaccaaccttattattgcccatctttctgattacagccatcctagtgggtgtgaagtggtatctttttatggttttggtttgtagttcctactgcatatctttgtagtagtatttatgatgaaatgggaagtatgccttaataaagcatttttgctgcatatcaaaataagaattgtctttaaaaaaccacttttttccctcagttatgcagttctgtgagttgcaagctgaactagatgctattttcatcaaatactgtttttacttgaaagaatgataaactgtggtcttgagattaatgtacttaagtgacagatatttcctcaaa

SEQ ID NO: 90032 - DNA, 648 bp, Homo sapiens
  misc_feature (596)..(596): n is a, c, g, or t
gggaagtggtgatggacgtgagtggagacagagtgagtggaaggtgctggggcgatgggaaggcaggaactgtgcttcagagagttgagagcctgaggtactggttgtcagaggcgtttgaaccacagcaactccatcttgaataggggctgggtaaaatgaagctgagacctactgggcttgcattcccagacaattaaggcattctaagtcacaggatgagatacaaggttggcacaaaatacaggtcataaagaccttgctgataaaacaggttgcaataaagaagccagccaaaacccaccaaaccaagatggtgacaggtacgacctctgttcattctcactgctacactcccaccagctctgcctatggaatagtcattcttttattcctctactttcttaaaaaacttgctttcactttactctatggactcgccctgaattctttcttgtgcaagatccaagaaccctctcttgggtctggatcgggacctctttcctgtaacactgggaggccaatgtgtgtggatgacatggaattactcaaaatgatctaggttcatttgtttcgacataccttataaagcaagncacagggttgtctgaaggagcctaactggcggtgactgagaagggggctcct

SEQ ID NO: 90033 - DNA, 148 bp, Homo sapiens
tagtatatacagtatagatattttcccttcagacctaagtgacaaataaccggtgtcacattgtttgtatgttgtcattcctttgaaatggaaaaggaccactataggtgatcctgaggtcactagtgacttagatgaggttgattaa

SEQ ID NO: 90034 - DNA, 214 bp, Homo sapiens
ataggctgcaccatatagcctgtgtgcctgtgtggctattgcatctcggtttgtgtaagtataccctgtgatgttcacaaaaacacagaattgcttaacgatgcacttctcagaatgtatttccatccttaaatgaagcacgactgtatataataattagtcactataattttaaaacaatttgttcgttctttttaaaaaatcgtgtaaaaac

SEQ ID NO: 90035 - DNA, 412 bp, Homo sapiens
acaggtaaacagacaagcagagtgtagaatatagaatatacaatggaataaacaattatgaactaggtatacctgcaacgatataaatgaatctcagaataactattgagtaggggaagccagactgaaggaaagaacggatgttcctttttatggccgcttagcattccatggtgtataggtaccacattttcttcatccaatccactgctgatgggcatctaggttgattccatgtctttgctattgtaaacaacgctttgatgaacatatgggtgcacgtgcctttttgataaaatgacttacttgcctttgggtatatacctagtaatggattgctgggtcgaatagcagttctaagtgctttcagaaatctccaaactgccttccacagtggctgaactagttttta

SEQ ID NO: 90036 - DNA, 190 bp, Homo sapiens
  misc_feature (33)..(33): n is a, c, g, or t
  misc_feature (135)..(135): n is a, c, g, or t
tgagagagaccccgaagctccagcagtgttttntgagcccagctcgcacagtgcctggcctggtggcgaggctccctatccgccctgggcagccccttggcgccgggaggcggcggcgtgggccggcctgcagtntggagcgccccgatggaaatacactgtaagcacgacccgtttgcatccatgcata

SEQ ID NO: 90037 - DNA, 124 bp, Homo sapiens
tccatccatctacccatctaaccatcatctacccattcatccattaaccatcatacatctctctctccatccatccacctacccatccatctatctactcatccacccatccatttacccatcc

SEQ ID NO: 90038 - DNA, 244 bp, Homo sapiens
ccatcctctccctcaccacccctgaagatgcttgaatgactttaataaggctgagttgcagccctcacccctgttatccccactaccccagtcacctggcactttccttcagccagcgaggagaaagcgagtggatgaggtgagaagcagcacctgctgtggctcaggctcaggacttcttttttttttttgagacagagtctggctctgtcgcccaggctggagtgcagtggcgcaatctggc

SEQ ID NO: 90039 - DNA, 387 bp, Homo sapiens
aggaaagggcaatgactagactaagaaacagcattaaaataaatgctctttatcaagagcagttgaaaagccagtttcagtaaggtttgttgtaaactgctttctgatttttagaccaatgctatccaatatgatagtaagtatcctttctttttgctcttttaaatatggttactgaaaaactttaaattgtacatgtggctcacattcatgtttcagttaaagagcactgatgcagactatctagatcatgaaaatattgactaaatttggcattagagctcagtactcattctgctgttgtttttgttttttttttcccctgagatggagtcttgctgtgtcacccaggctgaagtgcagttgtgcaatctcagcccactgtat

SEQ ID NO: 90040 - DNA, 935 bp, Homo sapiens
ggtgggggcagagtgtcggactgaaagtcaggaggctggggagctgggtcctctgcttgctgatggaccatgggcaaatgtcctcctctctccaatcttggggtccttatttgtaaaatgagaggattggaccacagagcggtgaggatcatttcttttctgatttcctttgattgcacaaacactgagacacttttggtagggaattagatgtctctcagaatcttttgtctctgagaagatgcctagagaaaagggaattcaataggataaaagtcattctccagattcacatttattttcctaccactttctgcatgttgacagaacgggaggaacgactgggtgttgtcaaggattctgctcactcacccccaactctaacccaggtctgtgttctgagaagggaaaaggttaaggaggttaaggtcatctttttattcaagttttcacacacacacacacacacacacacacgcgcgcacacacacacacacacactcaagcctcttgctacattttcatccttctcattcttcatcctctcctgtctctatccctcacttctcacctctacttagtgcaatgtatcctctctttgcccgaggaccagatgatggaggcatgtttcctactgagaatgattctagaccttttcttcaatggactctggggttagttgaggacagtcaggctcacacttcccagttatcgaaggtgatgataaaaagcaaatagggcatttgggagggacctccccaaacaagtacagagatgaagtgaagacagccgggtgctcagggagcatcttataggtctcagtccttgactcgtaggttgaaagcttaaaagtacagctgttttaaggagtcagcctgagtgtcctgttgcaaagggagaggcagaatggggtcccccgcttttgttctatctcc

SEQ ID NO: 90041 - DNA, 580 bp, Homo sapiens
gcgccgccaagcgcgcgcacagaccctccaataaacacaaaggagggcctggggaatagaaacccaaatccacttgtaatcgtacaagagattcgggcgtaattacttgagcaatctagattaagattgatgatcctttaaagtggtgcttcagatcgactgcctctccctttccaaagaaaaaccttgtgcaaccgaggtggaccccgactcggctgggcagaggccgaggcccagagtccgcgagccccgggggctcatcgggggatcgagagcagtgaaatgaaagacagggctgtgcgtgggtctggcccgggcagtcccgacagggctgaaagctgacactgtcacagtttgctccttagccacccccttgtaatcgcgacagaagccagcccagccctctgtgttcccgcagcctcgggaacggcccggcattgtgcaggacggtcgcagattgggtgtgtgctgcgccagggaaagccaacttggccgcctctcccgagcccggcccggcgggggccgagggcggtgtcggcgcgagggctctccgcccggagggccgaggcctagcggccgc

SEQ ID NO: 90042 - DNA, 331 bp, Homo sapiens
gccaaggaaccacgggttccggggacagagaggggggaaggaaaatgcaccctacaaataggaagggaaagctgattggccaaggcgtgcgccccggcggccaatcgaaacgccgggctgccccctcccttagcaacgtggccccggcgttccaaaatagaacgctcccgggacgtcaggggcggggcggacgaaggggcgccgcgcgccgtgcgtgccccgcgtcagacggaggattccagcgcgtcagccgttacgcacgggtcccccgttacgtctccgcgcaggaggcggaggcagcgcggctgagggttcgaggcccctcttcccg

SEQ ID NO: 90043 - DNA, 330 bp, Homo sapiens
agaagcaacataaatatccaccaagagagatctggttaaataaatgatgatccacctctattttgaaataccatgcaatgctaaaaagaataaggtagttttatagtattaactgtccaagatatactattaagtgaaaagagttgcaaaaggctatgtatattagtatgaagccattagtataaagaagaggagaaaaaaatgtataactatatgcttgtaagcataggtgtactttgtggaagcatactcaagatatgcaacaacggttacttgtgataatgggaatgaacaacaggcagatttactttcatatctgatttactgtaa

SEQ ID NO: 90044 - DNA, 559 bp, Homo sapiens
tgtatttctgttctgaagttcccataccagatcccttaggccaaagttagtacagccaatatttgcctgtttctttggattgtgtgtccatgctggagaaaagccttgttactgtgcccagtgtggtaaacgaaattatatgtacgcagtgagaagaaaaatgaaataagaagcactgatgaatgtacccacgggtgtgaccttgggggccagtgtgtggtttttatgaaatgaacgcatgaatacgaggaccctaattattgctttcaacggacaaagtatggtgaatatatagagaacgttgctgtacaacactggctgtgtctcaaagcggctttagaagtaaatatagaaattctttggtacatggtattgcatagaaaagtcattaagaaaaaagcaagacaatttgttaagaccttgttaagtggagctgggggatgattaattttgtttgtttgtttttgttgttccctggtagagctcaacaaactacagaccacgggccaaatctgacccaccgctgcttttgtaaataaaactttattggaaaaaagcc

SEQ ID NO: 90045 - DNA, 346 bp, Homo sapiens
ctacactggggagtgggcgccatcatccctattctacagagggaaactgaggcagagaggcccactgtctgggatttgaactggggatgcctggctcctgtctgttttcttagccactccccacacaccccaggtcagaagagcagcagctggagctgagacccccaccaggctcatggcccttccctactcagttcctgaaactccaccctcaagccgagctcgggaggctgaggcggggaggatcgcttgaggccaggagttcaagatcagcctgggcaacagagcaagactctgtctgtaaaataattttttgaattatttttaggccggccgcagcctcgtg

SEQ ID NO: 90046 - DNA, 218 bp, Homo sapiens
ggatcactgtggctgcttgtgaagaataactaatagaggcaagggcagatgcagggagaccagatagaaggctattgcaataatccaggtgagagttgatggtagcttggaccaggatgggagttgtgaagctgctgcttcaggtgattgagttctgtggtgtgttacttactcctctctatttttctgtcatttagtttgtgccctgggagacagtt

SEQ ID NO: 90047 - DNA, 673 bp, Homo sapiens
aggtgaggaaataatttcagatctgctggcattccataaatcacaccgtgtaagtcaatttggtcactgactattgtttaagtgcttctctgcacaataaagcataaaattttttcagtatagttattgattccaacatagacaagaactctgaaaagcaccccttgtcatcattattctatgattgcaagtctcctttttaaaagatagcaaaaaaaaaatgttgctgttatagaattctttcttagatatagtcatccctctgtgtatgtgggggattggttccagaacccccacatataccaaaatctgagtttactcaagaaccaccaacccatatatacaaaaagtcagcccctccatatacatgggtttcaaatcccacgaatactgtattttctatttgtgtttagttgaaaaaaatccacatgtaagtggacctccacagcttaaagtggtattgttcaagggtcaactctgcctgttttaactatagtgaactttggtttgttatgacttgttatcatgaatttatcctatatatgaattcaaatgaatcaagctcttcctgtgactccccacccccatttgtcctatattaaataacacgggttccaatcttctttaaattttcatgatctggcttcataataaagctttatagttggttctt

SEQ ID NO: 90048 - DNA, 131 bp, Homo sapiens
aaccatccttttcttggggttgcgctactgtccaatgagcgcatagtgagggcagtactgctaacgcctgaacaacacacccgcatcaactagagcttttgctttattttggtgcaatttttggaaaaata

SEQ ID NO: 90049 - DNA, 253 bp, Homo sapiens
tgattccctgggtctgggatagagtctggtattctgcatttctgactagcctccaggtgatactgattctgctcatctagggacctcgctttgagtagcaagtgtttaggccacttactagcaggaactaagcacagtatcctacaacagcaaatgtctttccaacaagaaagacgagagcaaatgctgatgccacatctgcactgcctcagaaaataaagaagggatgaggagcccccgagtggcactctgt

SEQ ID NO: 90050 - DNA, 197 bp, Homo sapiens
tttttcatttctgtttttttttttacttccccacctgtttccaagtttttcatttctgaataaaatgaaaccagagatttctttagagcaaagaaaatggcctaaagtgagagatttctgacttagagattttaggtatgttgctaaagagaaagagctatgatgtgtaagggccaattctgttgctttctctgttt

SEQ ID NO: 90051 - DNA, 608 bp, Homo sapiens
ttggctgaaggaaagctggaaactatatattttaaatctacaagctaagaagatggtggaaaataaataaacaaacaaacaaacaaacaaatacatggccaggatcttgggaaggaagtgtggagaaaaaaacaaactatttttccctgctttcatgccacaacaatcaacacagatttctgtgactaagtgtggagtggggggtccctgcataccaaacatgaaatcaattctgcggtggacaccagctgggcattctccaaccctgttcacttccaacactaccttgcagatagagtcagatcacacagattgaggactcagtcccataagactgctgttttccccactctgctccctgcttccaatgctgaccataagccccagcttgttttacctgtgcttctgaccagctggctacaaactaaagttcctgtgaccccctccctgggtctgattaatttgcaacagtggctcacagaattcagggaaacagttatgtttatcactttatcataaaggctattacaaaggatacagataaagagatacatagcataaggcataaaggaaggggcatggcgcttccatgccctcccaggaccacc

SEQ ID NO: 90052 - DNA, 149 bp, Homo sapiens
ttcccagggaagggggtgcttaagacatgaagagtgagctggagccagggaagggcagggacagaaacaagggcctggaggacaggatggatggagagggctgcatggagacccccggcaggagggcagaggggctcaaggcacccggc

SEQ ID NO: 90053 - DNA, 295 bp, Homo sapiens
ctttccttctgtaactacctcaacacattcactgcacagaatagttccaccaattacaaatgttcagaataacggagggcctggtaatgatcaaattcagttctgtgaaaagacctcattttgggacagttgctgagccaggacttaaactgggctcaaacccagcacactaagaggacagcattttggggttttgccgaatggagggaaaagataccataatgcagttccaggtacttttagattctttcctctaagaccccactttctcattataaagtggaaataataatac

SEQ ID NO: 90054 - DNA, 1120 bp, Homo sapiens
tctgactcctttgaagagggcatcaagaagtgaaagaacaaagtccttttctgttcgggatctgggcccatcctgggagaggtttttggcagaaatggctgcagtggaaccctctgactgccagggtgaaatagtgctccagcaggctgcggtagactcgctgccagagtgggtcaggactggcccagaggacagggtcgtctcttgagagtcctcccagctccagggcctgattttaaagcagtaacacgaggatataggttatatacaggctcctggaaggcaggtgccgcagctcctgtgacaccccatatgcctgagcaagcttctccagcacaagagatgatgcaagtatgaatgggtacggggggagcttaaaacctgccaacactgagacttgatgccaggggccgtgcacccgctctgccacctgctaggtctgtgcaatggtcagagcagaggtgtgtgatgagttcagctcccaagcacatccacacttaggaagtgttctgtgtgtttttaaataatccttaccatgtaaagattgtattacatttgtatacaaaatttttttgcattttacttttgtaatatttggggttttatagatttttattttatggccaagtatacttttgtaaggaaatgttgaagtcttgagtatttttattcttttaaaaaactatagttagtgtcaactgtgagcactgataaatattattcatgtgtggttttccttctttttaatccagactttttaagaaactgttttggcatagagctttacttaaaatgctgcttcattttacacattgtgaatactgaagattctaaaaaataaagatgcatttaaaatctctgtgctgttccattgtagaaatggtaatgtgcattgctttgccaaagtggtaattaaatgtttaatggtttagaactcctagttcacaacagggcttctcgtcatcacttgcagcgtgtgagcttccaaataagccgccatttctttggaaaacgcacgcacttaggcatggcgatctcctgttccgttaggaaatacggttatgttgacattatggttactgtgcttgtggttttgcaataaacatgtattgaaagcact

SEQ ID NO: 90055 - DNA, 496 bp, Homo sapiens
aggaagagtcaacatttaaaacataatttgtgcttttcacaaactcctgaccctaggaacaactccagtctagtgccttggagatgggctggtgtagaaagacatggaaaatgcttctctaaagaggagagctttccagcacacagcagctacagcatgtttctcaaagtccaaatcaatggcttctctttgtacttacaagaaaatcctaattcttgcactgatcccatgggcctccaagggcccgtgggatcagactgctgcctgtctctctgacctcatcatatacggagccttccctcagtcatacctttccaccacactgaacttctttcagctcctccgacgctccaagcacatcccacttcggggcctttgcatctactgttctgccagatttttgcatgacccattttcactattcaggtttctactcaaatgtcaactcttaaagaggccactatgatccatcctattgaaaatagggcagatactc

SEQ ID NO: 90056 - DNA, 431 bp, Homo sapiens
gtgatgtgagccagtgacggcattaactttaggtaatacttctatggcctttgtaaaaatcccgcgttaaggatgtattagatcttgagttcttttccgcgctggaggcaccactagattaaccctttgccggtgtattgcgtgtggggcgcacggctctgggttgcaaatattccggagatgctttttgcagcagctattctgttcagttgttcgcaaagaggaataacgcttcctgggaaccgcggtgacacgcttctttaggactgcctgcctacagagtttttccccgtggaattgatgtaacgattgatttatttcttatattctatgaagactgggggacccgccctcgcttagaatgtttcccggaggagaatagaagagtgcaatgtgatgtttttcaaattgtgtctaacggagctccctaa

SEQ ID NO: 90057 - DNA, 154 bp, Homo sapiens
ggtcacattttggaggactgagctgagcaagtgctggtcacattttggaggactgagctgagcaagtgctggtcacattttggagactgagctgagcaagtgctggtcacattttggagacagctgagcaagtgctggtcacgtttcagaggac

SEQ ID NO: 90058 - DNA, 307 bp, Homo sapiens
acccccaaaaaagcactaaattcttatactccaaatatagacatagggtcttgctttagtgtccaggttgaatttgaactcctgggctcaggtgactctcctgcctcagtgttccaagtagctgggagtacaggtgtacgccaccatgcctagctacttcaaaatcttaattataaatagatacaggactttaagtcttgaaagtgcttcatggttatcttattatttcaaatattattacctgactttgaaaagtaatcagtttaatgtatgcagaactacaacaaggcttattagggtctcgctc

SEQ ID NO: 90059 - DNA, 352 bp, Homo sapiens
ctccttgaagaccagaaatctgatgcatgttgcctgaatcaccagtgaaaaacatacccttctaaatccttggaaagcaggatgttttcctgaaacaaatctggctatcatgtgagatggctcaaatttaacacacgctacacttcagcaggtggcctgatagggactttcatttgagaatgtgtaaaataacaggtttgtacttgaaatgagtctttaccaatttatgatctggggaaagcataatatcagtaaaatatatttccaaacagtaatgtttatcctctgacaatttattgaagggaagtaaagtggtaaagttttatctcaataaaatttatgccgtggcata

SEQ ID NO: 90060 - DNA, 436 bp, Homo sapiens
caatatcaaggcagattcagtgtctggtgagggcccacttcttagtttttacaggactgtcttactgctgtgtccttacatggcagaaggggctaggcagtctcttaggtcccttctttaagggcactaatcccattcattagggctccattctcatgacctagtcacttcccaaatttcccacctcctcatgccatcactttggggttagaatttcaacatatgaattttgaagggacacaaatgttcagatcatagcatatatatttaatcccacatctcctgtgactatgtaagacctatctcttcctaagagataataatcttgagggcagaagtcaggcttcttttgtttagcactgtagccccggaggtcaggcttgtgccttaaatgtagcagggacttagtaagtagctgtgattaaataagtgaatg

SEQ ID NO: 90061 - DNA, 484 bp, Homo sapiens
gctgggattacaggcatgtgccaccatgccagactcatttttgtatttatagtagagacagggttttgccatgttggccaggctggtcttgaactcctagcctcaagggatccgcctgcctcggcctcccaaagtgctgggattataggcgtgatcccagcctagcctggtatttctttatagtgacacaaggactaatacaaggtccttccttaggatagaaggagagtccttactgtggggataatatcagaataatgctagaacactttctgctgcaagggacagaaacccacctcaaaccagcttaagcaaaaaaggaaatttatcagctcattgattcagctagggtaggcagggttatgctgtggtaacaaacagccccatctcagcagcttagaacaacaaaggattgattccttgctcacgatacacgtctatcacaagtgaactgaaacttcagtccgtatctccttgctcaagg

SEQ ID NO: 90062 - DNA, 450 bp, Homo sapiens
tgagtgagtggtcgatcttgctcactacaacctccgctcccaggtcatgcaattctcctgcctcagcctcctgagtagctgggactaaagacatgaaccaccacacccggctgtaatgttttgtatttcttagatctttatcaagtaaatgcttttaattttctcattacccacactgaaactgtaatttgcatcagcagtcctttgtgcacaaccacagttctccttcacatcgtatttattctgtacccaaatgtttatggtagcaagaacattttatattattaaaacataaaaataaaaagactgggtttggtggctcatgtctaatcccagcactttgggaggccaaggagggtgaatcacttgaggtcacaagtttgagacaagcctggccaacatggtgaaaccctgtctctactaaaaatacaaaaattagctaggcgtggt

SEQ ID NO: 90063 - DNA, 537 bp, Homo sapiens
gcccagttcaaccaaaagcagcactaaaatgttcaggtctgattacaaaggaggagttcaacaaccctgcctgcttttactcactttgaaatcagctttgctcttcctgcctgcttgtattctctttatgacagggtataaaggacctaaaagagcaagaagaaccttgggtctcttttgagccatatagtttggtccaaatagttcttgtctgaggaatccaaagccaataaccagataataaatattacagaaagccttacgcttttttcagtgattgctcttgtaggtgaaatagagtacggagctgacagtgtcaagccccaaaccaaaacttgtgtaggctcctatcctaagaggcccaggccaccattaaattgaatattcatgttttatacattttatttatgcatatattgtgaaatatacatatcttatatttcacaataaaagttttaaagaatgttacttgcccaccctagtggccaggggataagaccattaccagaaggtggacatgaaagcttactgagcaga

SEQ ID NO: 90064 - DNA, 371 bp, Homo sapiens
aaatttcccccactctgttctttgtagtgaaaaaagcaacttctgagattttatttttctccttctccttccccagtgtatgcctgcctactcctaatatgtaggtcatattagaataggtgctctataaatgttagtttctggtaggaaaagattagtttttaatttactccaataatggtttgggtgaattttctcagatagaggtccaaagtaagagtcagtggtatatcaagagaaccctgactgtttattacagcactggggagtttgtaaagattctgggatgaagagtttcttatctcccagttgaggagaaaacaagaccataacgagagcctcagcagtgaagccagtgctggatgaaaaaa

SEQ ID NO: 90065 - DNA, 481 bp, Homo sapiens
gcactcgttgttccccttggtagacagcagggtgcagctgtgaagtcatttttcccagtgagtggtcaccaatgtgcttagcaaggagtttagcatttgtctggttgtccactagcagataatcatttgccccaacccaccatgttcagaaatctctttctgatgaaatctcaaagcagcttggtagagccaggcatttgtgaacttagattttttttttaaattgtggtaaaatatacataatgtaaaatttaccatcttaatcatttttattatttatttatttatttatttatttatttatttattgaaacggactctccttctgttgcccaggctggaatgcagtgacacggtcttggctcactgcaacctctgcctcccaggagaatcacttgagctccagaggctgaggttgcagtgagctgagatcacaccactgcactccaacctgggcgacaggatgagactctttcttgga

SEQ ID NO: 90066 - DNA, 451 bp, Homo sapiens
tagatactcagatctgtaggaaaatatgaagaacaacagaaactaaatatgtgggtaatataaaaagacaaaatgtagttttactttcctttaaatttctttaaaaggctgtaactatataaagcaaaaattataatactgtttggtagggtttatgacatatgttgatgcaatatgtatgacaatgagagcacaaaggatggaggtataagagcaactacactacagcaagcttcctagtgtataatcttccgtttaagtagacattaatatactaatggtgcacattgtaatacacagagtcacaactaaaaacagtgcaaggaagcataggccaaaacacaaaggagggattaaatcagactactaaaaaaatttgattaattcaaaagaaggtaaggaaagagaagtagaataaaatatagttaagacaaacagaaaacaagttggt

SEQ ID NO: 90067 - DNA, 529 bp, Homo sapiens
ctcctcctaacacgtgaaccacatcatgagatgtggggagaccccgacctggtccagtggctgaaggaacacttcattttatttttgttcactcttatctgttgactccattgactttcaaagctaactatttaaagatttatgtcaccagaaagcacatttcccttcttttcttctcctggcttatgaaagcaaattaccatcttttgcctttatgttctttgaaaatatctggtagactctgaaaaacactggagaattcccaggttgtaggtccatttgtctgtttataacccattatgacatgaccatgtcttcaccattcctcctagcgtaaaggcagtgattctttttggactcctggttgccattttctgggtgtggtaggactgaggacagggattagaggaaagctagagactgcctagttttctagaacttcctcataatctctgaaagggaaatagggaagtagagaagcagagtccacaacaaacacaaacctaccacctttggtgtcattctcaga

SEQ ID NO: 90068 - DNA, 363 bp, Homo sapiens
gattgtctgaaccatctgtttttatattctgtttaccctactgtcagcccattttggagttgttaaaatcctttgaaagtagttgggaatttttcacagtaagctgggaatctataccactctttaaaaactttgtgtttttagggtattcccatttaatcctccagagaataattactttttaatttaggtgcaatgtgttaaatattatataattaaaatgtttttctcccttcccaattacttattcttagaaatcaaagtttaaattgtctaaataggtacttggccatagtgtgataacactaataacagattcgtaatgatagaatgtaaatattaatttatatgtcccctctcatt

SEQ ID NO: 90069 - DNA, 167 bp, Homo sapiens
atattttattctatttatatgaaatgtctggaataggcaaatctaaagagatggagtgtagagtagtggttgcctagagttggtggaggggaagattgagatagggaatcatttaaaatcccattaaaatcctccactcaaacccttaccattgattacattacaac

SEQ ID NO: 90070 - DNA, 554 bp, Homo sapiens
  misc_feature (544)..(544): n is a, c, g, or t
gggcaccagagaggacagagaacagcaaaaagaggggagaggagctggagaaacagcagaggaggcagtgactttctgagaggtacctggaaacgccccccactctcccttcacatcctaagtcctttagaagagtggggagaggaaatcagaagagagcagaaggaaatgattgaaggtttctcctaaagttaaacagttttcttccttcattctgtaaagcgagtgtgaggaacggaaggaagcatttccacacttttttgttcctctccgcctttactgaccgtctagcatgggtctagtcttgagtcaggtcctgcgaggaatgaaagtatggacctagttgctgctttcaaagagctggcaacgttgttggaatgacaagaccacacaagggagaacaattagagaacaagaagaggtcaggacaaaggaaaaataattaagggcaggtgggacaaaattaacatatcaataagttacaaaaatacaatttagttttattaaaagggaaggttatcagaacggacgggtttgcaatggnttcgatgtta

SEQ ID NO: 90071 - DNA, 1456 bp, Homo sapiens
ggaattttcttagtagatagatgtttcaaaaacaaagaatcttatctcagttcctgtcatggctttcatgtgtaatcgaaaagtatattagaaaaagtactggattaaatttgcctttcttaaagtataccttttacaaaagtattgatttgcagttaaaaagaaggtggggatgcctctgctggtgcagtatcttgtgaagataaatagactcctgagtggtgaattctgatctctttcacgttcattcttaactttctattttagtaataatcatagttaccattgattataagtacccagcactgtgataaattgaattcacattacatttatgacactttctaattcaaaacacagtcacagtagagtttttatcaatctgtacactggtaagcgatggtaaaattatggccctgatagcttcacagactaatggaaaatttctgaaagtttacaagtacagaaaaacaaagaaaaaaaacccagtcttttataaggaatgtagatacagaccattgtacaatttaaaatatacataatgtcagtcttttctttgtatggcaaaaatgacatttgggaactgctcatggtgactcaacgcttgtaatgtaatcccagctactcggaggctgaggcgggagaattatttgagccccagattttgaggctgcagcgaactatgcaatccagcctaggccacagagcgggaccttgtctctaaaaataaaaaataaggtcaggtggaatagctcaagcctgtaattccaacaactgggaggtgaggtaggaggatttatcacttgaggctagtagttcagggtcagcctgtgcaatgtagtgagatctgatccctacaaaatcaaaatagtagctgagcttggtgtggtgcacactgtagtcccagctactcaggaggctggagaggatctcttgaactcaggttgaggctgcagtgagccatgatcatgccactggactctgtgctgagcaacagagtgagaccctgtctctaaataaataaataaacaaataaaaaaacagtaaaaaaaagttcagttcaatccttatctgtattaaacttcctttaacttgtgtggagttacatttaatattttcttatatgaagttcaaaggttataacaatttctgatccaatgaatatttactataaaatttttaatataaatgtgttgatggtgtaaaagcccataaaaaatgggaagtttatattgtcttgtgctttggtgtatgtatacacattaccttctggactctatcatacattttcataattactacattacatatataggattaagtttaatgtactctttttagtactaaagtcagaaatattttggtataagaatgatcaacttgttgggttctctaggtgcctaaattatttcatatttatacttaaaagctactgaattaaaatactttttaatac

SEQ ID NO: 90072 - DNA, 586 bp, Homo sapiens
cggtcgatctagagatcctttttctgccacgactcgaccaggaggtctgctggcttcacctctcactgggattacaggtgcgtgccaccatgccctgctaatttttgtatttttagtagagatggggcttcatcatgttggccaggctggtcttacagttttcgtttgataaaatgctttttgtttgtttgtttgtttcttgagttcagattcagtagcctggtataatgacaaactagaaatcacagtatgggaaaaatataggagatgatgctttgatttcaggaatattgtggattatcaaactaaaattagcagattctatttagcctcttagaatttcaaaaatttttagacattagtatacatccccaccttcacgatatcagaaataaagggtagtgaagatagcagagtgaaatatgagaattgtctccatttcagaaggtatttggctgaaatgagacatttcacaatttggtcttctggtctgctcatcactggaagtcccagcttcttcctggataagaagttgtacttggattatattattataaccacattgtaattattattgtggaaacac

SEQ ID NO: 90073 - DNA, 1792 bp, Homo sapiens
tatatctaaatgagccctgtatatctaaaactgatgagtgtttctaaatgttgatgtccatttacttgccttggtattaagataatgcaagtaaagtttagtaagtcatggataatgaaatgattatgtttctgaagaccatattatatttttaatttttagaggaatcatgccatcccccaaaaaatcaagaaatatttgaattttaaattataagttcattgttaaaagacatttttacaaatgtctgaaaatcttaaaatactttacatctacctttaagtagtagaatacagagctgtaaatttccatgccttttttcctgatattaagttttatagtaaaaaagcaactagtgattgcacaaagaatataaaaatccactctttttacaaaggtgtgaatttaaataacgttattgattggaatatgaaaatagaccaatcatttaagagctttttagcaaatgattcaattcttactctttttctcccaagattgaaaagcataatgtatttctctaaagtaggaatctagagagcccctgtgagtggacaaatgtcagtaacacttgaacacatgagaagataagtgttatgttgtgataatttaaagttaaatttgctttttgggtaggatccctaaatagatgggatttttaaatagatgatatatagatgacaattgcaattgtcattttaattattttccctacagtaaagaacctagctctgagcagtgaaattgtaatggcactttaaaggaagtaagccgttaactgttctctagtggagcgatctccaactgttttggcactagggacgggttttgtggaagaaaatttttccacgggactgggggtttagggggatggtttcaggatgattcaagtacattacatttatcattagattctcataaggagcatgcaacctagatctcttgcacgtgcggttcacagcaggattcgagctcctttgagaatctaatgccatggctgatctaacaggaaactgagctcaggcagtaatgcttggcaccgccccccaccttctatgcagcccggtcgtggcctggggactggggacccctgctctagtcagtaataaggtacttgtgccagaatataaatcaacacattgcttcctttatcaaagaagtcttgttatttaaaaaaagtcaactgagccagtatgattagtgatgtaattgattttcattctggcacaagcctctttcattctggacagctcacaaatagttaatggaccatgctttgaatagccttcctctaagcaacatttataaatactgatattttagaactgtttacatttcttctgtttatttttgaattttcagtttgatatcttgtccttattcattgttgtataaacaactgtactttaatttcaagtagtattaaaagtatttcacttcagtttggggggattattatcaatttataattttataaaagtattttaaagaataattgtaaattttccataaattacaacttcctgccatcttttattaaataataatcttgcttaaggcatatagacagacattattatgagtattccagtaaaaaaaatctacatcaacttgaccattctggctaaaaattaaaaagcacttttttatatctgtggttgtcatttgtttcaaagcatttctaaatttattgttcttaaaagtatgtctgcatgttctagcctttgacctaggtcatctatgaaccctctttgtgtctaataaacatatctgtaaaggcatataaatctga

SEQ ID NO: 90074 - DNA, 788 bp, Homo sapiens
tttctatagagatcgccctgccgagctagcggccgccgccagcttcgtattcatgcccgggttgtgaattggaaaacaccttgaccctgctctagtcagtaataaggtacttgtgccagaatataaatcaacacattgcttcctttatcaaagaagtcttgttatttaaaaaaagtcaactgagccagtatgattagtgatgtaattgattttcattctggcacaagcctctttcattctggacagctcacaaatagttaatggaccatgctttgaatagccttcctctaagcaacatttataaatactgatattttagaactgtttacatttcttctgtttatttttgaattttcagtttgatatcttgtccttattcattgttgtataaacaactgtactttaatttcaagtagtattaaaagtatttcacttcagtttggggggattattatcaatttataattttataaaagtattttaaagaataattgtaaattttccataaattacaacttcctgccatcttttattaaataataatcttgcttaaggcatatagacagacattattatgagtattccagtaaaaaaaatctacatcaacttgaccattctggctaaaaattaaaaagcacttttttatatctgtggttgtcatttgtttcaaagcatttctaaatttattgttcttaaaagtatgtctgcatgttctagcctttgacctaggtcatctatgaaccctctttgtgtctaataaacatatctgtaaaggcatataaatctga

SEQ ID NO: 90075 - DNA, 221 bp, Homo sapiens
tatacctgtgaggatgccagtgcttgggaggaaaggggtttgccagaggtcacttggccagagctgggagtccaacacctgcctatctgatatcacagcgtgtgctcttacccgctgcacagtgctgcccacctcctgctgcctgaggagccaggccctgaggaagccatgcttggctccctggagcagtggcacttccccttcccatggaccacatcctc

SEQ ID NO: 90076 - DNA, 416 bp, Homo sapiens
caaggactaaaagttaggactaaatccctcttcccctaccctcctcatcaggggcagtttggggtgctgagtaaaggagacgctttgggtcccgacagccttgcagcatctccaccttctgcagcaaacgcggcctcttcccatcagctgcaaacacaggcccagaggtcctgctgggaggaacgcaggcgcattgctctcagctttgcttttctggcctaacctaagcaaaattaaatggacagattttggggtagtaataagatcaacaggaagtctgaacagacaggacccagggccgtcctggccatctgggtagcaggagcttgtcaacagcctctcgggcctgccacgggagtgagagagtgcgctggatctgcttctcatatccttacatcatttcgctcaagattcac

SEQ ID NO: 90077 - DNA, 816 bp, Homo sapiens
tgttaccttccaaaagtgaaggcagagcaaaattaagcatgtttagccctggatttgagccaatccaacataaggaaattttgttttttttaagtagcattgcttttagaacctgtgaattttccttttgcatgaagatgagtgcagtactgtcttcaaaatgattgtagaatttcttggtagctttacaccgaaaaatgcgtgtaactaaataccagacatcttgaccattcagctagaaccctggcagcaacagagctatttaattgtacaaatgtgtgtaaggattatttttagtgtactaataaattaaaaacaaagctaccctgtcctcgttagtcattgctattcaatcattccagtcccaagttatttttgtgccacttggaatatgagtatttctattggtaactacaaactctatcctgtgtttgtaagaggagctgtgtaagatttttttcatttaaagggacaatttacttcattatttatctttcttttgttatagcgttgtaattcttctcagtttttctttgcacatttcaatatgcatggtttaaaaaccattaacttctctaccttttgtacagtaaggtttcattttcacactgtatagtttcattttattgttttgctttgtcagttatatacagtataaagttgctatgcacagagctttttgtaaagacagcttttttgtttactgtttttaatggtcttacttaaagaatatcttgtttgtaaaatgaatatgtctacttcagttttaaactttaaattatcctaacaaaaaaataaaatttttgtactgtaaaa

SEQ ID NO: 90078 - DNA, 418 bp, Homo sapiens
tataggcacccaccaccacactcggctaatttttgtatttttagtaaagatggggttttaccatgttggccaggctggtctcgaacttttaacctcaggtgatctgcccaccttggcctcccaaagtgctgggattacaagcgtgagccaccacacctggcgtattctgacattttcatgcactatctcttcacagtatctttgtaatagatactatcattatttatatttcatagatgaggagactgagagaacttggcaacttgcccaaggtcacacagctcactgggtaatcacaaatcctcacaaatttggtttttaggttttttgatttattttttgagacagagtgtcgctctgtcacccaggctggagtgcagtggcctgatctcagctcattggaacctctgcctcccca

SEQ ID NO: 90079 - DNA, 386 bp, Homo sapiens
cgagcttaagggttccggagagtcagggagctgcattcccatgcagataggagatgctgcccttgaagaagggcctgggagctgcatagaaaaggagcatcacccacctgtgtggggcaggggaatgggttgagttgtgtctcccaaaaagatagtttgaaatcctgacacctaggctggtcatggtggctcatgcctgtaatcccagcactttgggaggccgaggtgggcagatcacctgaggtcaggagtttgagagcagcctggccaacatggtgaaaccccattttctactaaaaatataaaaattagccaggcgtggtggcaggcgcctgtaatcccagctacttaggaggctgaggcagcagaattgcttgaacccaaga

SEQ ID NO: 90080 - DNA, 557 bp, Homo sapiens
ctttcttgaatgtattagtttcctagagctactgtaccaaattagtacaaacattagtggcttaaaacaatatattgtctcacatttctggaggccagaagtccaaaaccaagatgttggcagagccatactccttctgaagcctctatgggagaatcattccctgccttttccagtttctgatggttcctggcaatccttagcattgcatggcttcttgacacttgatactaatctctaactttgtcttcacatggtcttctttctccctcatgtttctgtttctgtatctaggtatcttaaatactcctctcctttctcttataagattaccagtcattgaattttggccccaccataaaaaaacaggatgatctcatttagacatccttaacttaaatacttctgtaaagaacctatttccaaataaggtcacatttacagataccgataccggggattaggacttagacaaatttgtgtgggggaacacaattcagcccactataatgaacatatattaggcttcagtttttaaaagatggctttaaaaaaca

SEQ ID NO: 90081 - DNA, 834 bp, Homo sapiens
ggctgtggctgtgatggtggtggtggcggcggcggtggtggtggctgcggtggctgttgctgctgcaagggatccaacatgactcctgactttctaccattgatgcttgagctctcataagacaccacaccttcattcagtgaggaagaaatgctttcactctgggaattcacagcatcccaatctgacgttgtacccgtgtgacactgtttgtgagccccaagtttcaacgagctcttgcaagtaaacggacattcgtcacatttgtagacagctgtctttccagataagtggatgttttctatgtgacgagagatgctacgtcgatgcatggtgaggaaaggacaaaaggggcactggaacctattcatgaatcttctaaatggaatccccttggtctccaataatttgttgccatctgagcccatcagctgctctgcagacaggcctgatgtctggtgatccatagcacttaaaccattctcactgtctatttcatttaactcttcatcagaactagagtcatttagcatgctgttagtttccaggtcagcagaagaattggtcatgtcagtcattccataacgggatctctctgtcaagttaactagaccagaattgtgaggtgacttcggcttcatctgagggtaagacatgggcgaaaacttggaagctgaagaattgggtctcatgatggagttgcccatggagcccctgaagttggagacggtagtattgggtatctcccggcttgcagcattcatggtcagataggtggagttggaagtggggctgggggcactcttgttcggcacatcaggtagattagttcct

SEQ ID NO: 90082 - DNA, 236 bp, Homo sapiens
taacactcagggaaaaaggaattatccatcgcagaaaactaaaactgagtttaaaggcacattactgacatgtttagagtcagccaatcagcaacagaattctgattgttctgtccccaccttcacccccacctcccctgtgggcttaagaaactcttacttatcctccaagactctgctcaggcatcacctctagaaagctctccttgcctccaccttccaagttgaattaggtg

SEQ ID NO: 90083 - DNA, 322 bp, Homo sapiens
tgagaattcaatttttaaaattcattctggcacatatttatttaagaattataaaaatattggctttcagcctgggtgcagtggttcatgcctgtaatcccagcactttgggaggccgagggaggtagactgcttgagctcaggagttctaggccagcctgtgcaacatggcgaaaccccatctctacaaaaaaatacaaaaaattagctgggcatggtggcacacacttgacgtcccagctactagggaggctgcagtgagctgaggtctcaatactgcacttcatgctgttttctataacagcctgggtgacagagaccc

SEQ ID NO: 90084 - DNA, 356 bp, Homo sapiens
ttgcgcttgcagggagaagtgtatagagcggagttctgtgcgctcgcagagaatgagtgttgttgcaatggctgcatgtgtccgtgctcaggaagatcatggtggtgtgccatccatgttgaacccagaattgcttcgtggatattcagacccctagactcagcatctctaaggaaggtggaaatattcagcctgctcggtggcaacaccatggaaagtttatttaccggctgtggtgggtggccaacccctggagaatgcccttctctggaggttgtaggagtcctttctaaccagctgttgccagatgagaaaaagaaagctgagcgagcttgtcccccgccccacgacaccac

SEQ ID NO: 90085 - DNA, 640 bp, Homo sapiens
ctcctacctttgtgtcaaatacgatactgatcctttcggcaactcaagggaaatggcctgcctagtgggagtgttctgcaagcctgtgagctcatgccactgcccgcgtagttactgcctcaaagccatctgctcaggttgctgagtgtcccgggagacggtgtctccactgatggagagagacaagaaagacagggaaggtagagaaacgcaaagaccagaaaggtgtatcgagagcggtgaagtctcctgttgccgccttcggccagcaggaggaaaggtgttatcaagagcagcgaagtctcctgttgtcgccttcggccagcaggaatggcagtgtttgtttggcacatggctgcatgtgtccgtgctcaggaagatcatggtggtgtgccatccatgttgaacccagaattgcttcgtggatattcagacccctagactcagcatctctaaggaaggtggaaatattcagcctgctcggtggcaacaccatggaaagtttatttaccggctgtggtgggtggccaacccctggagaatgcccttctctggaggttgtaggagtcctttctaaccagctgttgccagatgagaaaaagaaagctgagcgagcttgtcccccgccccacgacaccac

SEQ ID NO: 90086 - DNA, 367 bp, Homo sapiens
ggtaaaataatttttactaagacagttgtaggtaaagttattagcgaaagaagcaaaatccatcgcaagggaggccatgggaagcctgcaggagagaagcagaggcttgtgggtgattttatagaatggaacttgggctgattgatagtgccaaggcagcagagtgccaaggcagcagggagcttaacttgcattcctctgtcagccccggtgtttgataaattgaggcgtttgatggtgagcaggaagtctgtgaattaagtgcgttatctgggcaagaaggccatgtcttgggccataaagaaagttagacatgtacaggagttccagaccagcctggccaagatggcgaaaccccttctctact

SEQ ID NO: 90087 - DNA, 410 bp, Homo sapiens
agacagagttcacttaaaatgcatttaacaatttacagataactggaaagtaattcattcatcttagaaccctggtagggacattctattaaaatatttgtgtactagttaaagtcaaaatagaaatacagcctatcacacggtatttatactatgcattatgattaataaagccacctaaggtcgttactccatgatcatgggaagttgttagtcattaagagttcgggtttagcaacaaaaatcttgcgtttgaatctaaacacattacatgattttaagcatgttcatcattctgagattaaataaaaattaaggaaatatatgaaaaatgcttaataagtacccaaaaggtaatatggtgtagcaacttagaatgtagacttcagagccagtcagctaggattaaa

SEQ ID NO: 90088 - DNA, 308 bp, Homo sapiens
ccttacctcctgaagacctggattggagaggctagaacccagatgccagagtcagatccctgcagctcactctctgaatgaccttgggcaaattttttagtacttctgagccccaatcttctcactgtagagctaacctagtccaacaagttcatttttcaaaagatgacattaacgttgcatccccaaagccacacaacaagtaagtgcaaaagggagggcagtgaccaggccttctgccctcggcacgccaggcccttctgcgtcattatctcatctggtcctcactgccagcctccgggatgctg

SEQ ID NO: 90089 - DNA, 445 bp, Homo sapiens
gcttttgcttaagatgcctttgaatattcttttatgtggttttatataaatattagaattttgtttctacttctgtgaagaatgtcattggtattttgatgggattgcattaaatctgtaaattgatttggcagtatgaacattttaacaacattgattattttatttcatgcaatataaaataccttttcattttgtttcatcttctttaatttctttaatttatattttacagattcattatagaaatctttcccttatttagttgtttattcctacttatttgtaagtattgtaaagaaaattttttttcagaatgatttctattgggatatagaaatgctactaatttttgtatgttggttttctatcctgcattattacttaatttcaaatctctctttaaaatacattttataagaaagaaagaaataaaattcataga

SEQ ID NO: 90090 - DNA, 449 bp, Homo sapiens
gattcttcctcacttgaataatacttttcttccccagtattctccatattatcccagagtcagcccctctgtttttgtaaagatctacgtaacctcctctaagtttcccagttctcctcacctatcatatcatttggctcaacaaagggcaggaagctagattctaattgatattttgaggccgggagcagtggctcatgcctgtaatcacagcactttgggaggctgaggcgggcagatcactggaggtcaggagttcgagaccagcctggccagtatggtgaaacctcgtctctactaaaaatacaaaaattaggcaggcatggtggtgtgtgcctgtaatcccagctactcaggaggctgaggtaggagaattgcttgaacctggcaggaagaggttgcagtgagccgagattgctcaattgcaccccagcctgggtgacagagca

SEQ ID NO: 90091 - DNA, 244 bp, Homo sapiens
gccactgctcctgaccttatctaggtcttctttaatctctcttagaaatgttttgtggtttttagtggaggtcttacatatctttcagaagatttattgctagctatttatattttcttgctactgtaagttgtctttgttttctagttgtttgttgctagtatatagaaataaacttaactttgtatgttgacattttgtctagtggccttgctaaatttattaattctaatagcttgtagat

SEQ ID NO: 90092 - DNA, 115 bp, Homo sapiens
aagttcccctctgtattgagagaccataaatatcattttatggaaaagtcatgcttttctaaattcttcaataagtcaggatgtttagacactgactctgtggctaaatgggcaa

SEQ ID NO: 90093 - DNA, 369 bp, Homo sapiens
tccaatgtgtttggattcaaggaattaagggtctgtataaatacttatttttctgtgtgtgcattttcttgtgtttattttcattggttttgagtttgacttaatatacacatgtgcatttaaaaagatgatctttccaaaagctttgcttgggatctttgctaggaggatgagttaatggatggagagggctgcttgctttactgtttattttcccagacaaatccatggagacaggctgctaataggataggagaaaaacaacaaaaacaaatacagctttttggcctggaactgaattgtattatctgtactgtcagttagagcctttgctcacttacccagacgatctctacagggattaaagct

SEQ ID NO: 90094 - DNA, 430 bp, Homo sapiens
agaactttcgaattgagacccagtatttgtggctacctgtgtgtgtgcacacacacaactgaaacaatttcagcttagcctcactctccgtgttatattgtaatctatcctttttttccccctatttaatttaaaagaaaattgcttgtcaagagacccagcatattgatttcctattagggatcagcggtctagaagtacatcttgaacattcacagcttgtcctgaatttagctgtgggaatgtctaagggtactttgaccagtccatactacagagaccctttcttcatgatggtgtggtgtgcaggagggtgttcaggggtgacatgatgttctttttgtcaacttgggactttgatttcaccagagtaaagaggatcgtagaaatcttgctaagtcaaggaaattcttatttaccgccatagact

SEQ ID NO: 90095 - DNA, 2162 bp, Homo sapiens
ccgcggctccccgactcctttcccagaggtgagtgcccgaagccaggagcccggggcgcctaggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcgtcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccggcggcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccggtcccgcttccagtttccttgaagcgcccgccgcacacgccctattcagcaccagctccgcggacagttcccgcggtccaggcgctgtcacccttgtcagccgcgctttgggggaagtcttctgagaccacccagtgaataggcactaccctgggattcaagacagtcttttgtaactggcacacgccccacgccttcctctataacccccagagacaggctggggcagcgccaaggcggtctcgcgcgggactttgtacagcagtgtcttatccagcagccattggatgtaacgttttgctttgggttttttttccttttgttgttgttaatttttgtaaagcagacgctactctcaagcagttgacaaaactgtttatttttgcaattaaaattattgtgctaaaagcttactgaatc

SEQ ID NO: 90096 - DNA, 674 bp, Homo sapiens
cagcgctttggagaggcgaggagccgccgcccgaggccggtgcgggcgagcgagggcgccgcggctccccgactcctttcccagaggtgagtgcccgaagccaggagcccggggcgcctaggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggaggtaaggagggcgagcaggggtgctcagacgacgacggcgcagcgcgggggcgcaccatacctgagaaccaggagggactgggacattggagctatgagaataggggcgatgggaagcttaggagtcctggggtgcgcacccccattcccacccacactgggccgccagcgcctccgcaggaacctgtgcggttatcggagcgcccttttgcctgtgcacgtgtgttttgcgtgtgcatgtttctatgtgctccttgggacgtatgcgggcccctgctgaatcagaatgtgcaaaaggcactttgtgtatatccg

SEQ ID NO: 90097 - DNA, 184 bp, Homo sapiens
ggctgacactgactgtgggggcgaaagcgtgcttggtttgagttctaggactgggggacaggaggtggagtgagtgagtgtagatgataccttccagtgcccgaggcaggaagttgggtcaggagagaatgttttctagagggaaaattccaaacgtgtaggtacagccccacagtgtggccag

SEQ ID NO: 90098 - DNA, 136 bp, Homo sapiens
tatccttctaactgtagttaattcattcagttttgtgttgtagatgttcatccacacgtttccatgtagatctagtgcattgtaactgctctacagtatacagtatgggaggactccatgatttatacaatacctc

SEQ ID NO: 90099 - DNA, 881 bp, Homo sapiens
ttttttaaaaggaggtatctaaaatttaaaataattcaatcatttcccatcacttctgtaagttccaaggtctttaggacaacatcaggtttttttggtacccatttccctcagactttatggtgtgttaataatgaaatacaatactcaagatgcttgagtaggaatttcctctatgtgaaatggcttcatgtgtccttccctgctccttcatccgcctgacaaaattctgcctgtattttaaaatcttgttatcacaccacttccaacccatactgcacaacaaataagccactgtaattattattttcatagtttacctcctcatgagatactgaacttttggttttctttgcatctttggtatatgataataatttgagacataaataggtcagaaaagggtgtgaacaaaacttcgtatatggaaggaaaatttcatattaattaaaagcctactatgtacctaaccttgcactgtcactcacactcatttctcacaacgtgaagtaacaacaacaacaacataatggacaacacttatataacacttactagtgtttaggtatcaggatttagcataaacatttcacatatgttaaatcatttaatcctccacaaccttggagtatatatttctacccaatttagagaaaactgaggcacagtcattaaaatgaatgaaaactggtgtattttatttcctttaccactcaagttactttaagggtgctatatcactaagaaagaaacacagatagttttgccaagtaaaacataacccataaaaaattaaagggtttagaataaaagctgaaatttaaggtttcattgtatctactctccctcaacccaattaaaataaaaattcttttcagatc

SEQ ID NO: 90100 - DNA, 416 bp, Homo sapiens
gggacatgtcagtccttttcctcaagggtgctaggacccacctttctccccacacacctcagtttccaccaccctgctccccctgaggacccaccagtgccaggatggacacgaactggaccccccgcctgataaggggggcagggcaccttgaggagcaactgagagcagctggggccagcaggtcctaaggtcggggccagcaggtcctgaggtcaagcccagctctgtcccgtgccccagcatttctcatcatggggtggcatttcagggttgatctcacttggccctgtgcccgagggtgacctgtgtaatccctgtttacttggcaactctcaacctagagatgagagacttcacaaaaatccttacttggcccagagccctttgtcccaaggcgtcgtggtgctggggca

SEQ ID NO: 90101 - DNA, 2357 bp, Homo sapiens
gggaggcggagcgccgggacgccaagcacttcctgccgcgggcggcgcgccgcagctgcccaggccggaccgggccgggcgcccgcagatgagccccgctagggccgccccgcgctgagagcccagccccgccgctgcccgcccgccatgtctcagatgctgcacatcgagatccccaacttcgggaacacagtgctgggctgcctgaacgagcagcgcctgctgggcctctactgcgatgtgtccatcgtggtcaagggccaggccttcaaggcccaccgggcggtgctggccgccagcagcctctacttccgcgacctgttcagcggcaacagcaagagcgccttcgagctgcccggctccgtgccgcccgcctgcttccagcagatcctgtccttctgctacacgggcaggctcaccatgacggccagcgagcagctcgtggtcatgtacacggccggcttcctgcagatccagcacatcgtggagcgcggcaccgacctcatgttcaaggtgagctcgccccactgcgactcgcagaccgctgtgatcgaggacgccggctccgagccccagagcccctgcaaccagctgcagccggccgccgccgccgcggccccctacgtcgtgtccccctcggtgcccatcccgctgctgacccgagtaaagcatgaagccatggagctgccgccggccggcccaggcctggcccccaagcgcccgctggagacggggccccgggacggcgtggcggtggccgcgggggctgcggtggcggcgggcacagcccctctcaaactgccccgtgtctcctactacggggtgcccagcctggccaccctcatccccggcatccagcagatgccctacccccagggggagcggaccagtccaggcgccagcagcctgcccaccaccgacagccccacctcgtaccacaacgaggaggacgaggaggacgacgaggcctacgacaccatggtggaggagcagtacggccagatgtacatcaaggcctccggcagctatgcagtgcaagagaagcctgagccagtgccgctggagagccgctcctgcgtcctcatccgccgcgacctcgtggccctacctgccagcctcatcagccagatcggataccgctgccatcccaagctctactcggaaggggaccccggggagaagctggagctggtggcaggctctggggtctacatcacacgcggccagctgatgaactgccacctgtgtgcaggggtgaagcataaggtcttgctgcggaggctcctggccaccttctttgacaggaacacactggccaacagctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaaggaaacaaatgcattcattatactgtaaacaattaggccactggcagcctcctgcgaggaagttcccagggctcccttttgatattcacaaggtcagcctccaagtgtagcttccctcccccttcttggggagggtgggaggccgccaggcccctggtgcccagccctgccccttcctccctgcccttcctgctcctcctgcccggaagacgaagcaggggccggcggtggtctgtggcgagggggctgggctgtgcgtcactgacccttccttccttccccatggaacct

SEQ ID NO: 90102 - DNA, 1637 bp, Homo sapiens
gaaggtggcagttctgctacagcggccagtcctggggtgacaggaggccacgggtcccccagtacccgagacccaggctcaggagggacctcagtgtgaccggcaggggcctcttccttgctcacaagcccatcgaggggcctcctgccaccctggaacccagctctggccccgactcacggggcctctgaatggcccttccgggggccacgagggatgagccgtcctgtctctgccatgaacaagtctctctgcgggttctccgttaaagcccagttgtagcctggaccttgaagctcagctcctgcagaggtgcaagagaagcctgagccagtgccgctggagagccgctcctgcgtcctcatccgccgcgacctcgtggccctacctgccagcctcatcagccagatcggataccgctgccatcccaagctctactcggaaggggaccccggggagaagctggagctggtggcaggctctggggtctacatcacacgcggccagctgatgaactgccacctgtgtgcaggggtgaagcataaggtcttgctgcggaggctcctggccaccttctttgacaggaacacactggccaacagctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaaggaaacaaatgcattcattatactgtaaacaattaggccactggcagcctcctgcgaggaagttcccagggctcccttttgatattcacaaggtcagcctccaagtgtagcttccctcccccttcttggggagggtgggaggccgccaggcccctggtgcccagccctgccccttcctccctgcccttcctgctcctcctgcccggaagacgaagcaggggccggcggtggtctgtggcgagggggctgggctgtgcgtcactgacccttccttccttccccatggaacct

SEQ ID NO: 90103 - DNA, 727 bp, Homo sapiens
ctcacagctggcggacggccaaggctgctgggcctgaccaggccagagactgttccagaggaatggggtggggaggcctcccaggccgagcagtgagaaacgtgacctctggtcttctggctgaggccaggagagccccaggtggtcacatgggccccaggagcggccggggaggctcatccagggcatcatggttctgtggccttggggaggggcgggcctcccggcaggcaggtggctgagctcacgccgccccgtcctcacagtgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccg

SEQ ID NO: 90104 - DNA, 240 bp, Homo sapiens
tacacactcattttcatcttaaagactctacatttatattggtctatattggaaaaaacatagagatatggccaggacctgaaatctggtgcgcactgaagttgatcagggcagtgtgtgcttaatctgaacatcgacaccatcaggaagcagcaactccctgcatgattgacatttctctttttttttgaggtggaatctcactctgttgcccaggctggagtgcagtggcgtgatctc

SEQ ID NO: 90105 - DNA, 297 bp, Homo sapiens
atttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaatatgaatgagattgttacacaaattgatgcacaaaataagctggaaaatggtccatcacatggccactctataacggatcgtctagagt

SEQ ID NO: 90106 - DNA, 576 bp, Homo sapiens
ctgggatcccaggaaacccctccaaagggacgcagcccaacaaaatgagtattgatcttaaaatccccctcccctaccaggacggctgtgctgtgctcgacctgagctttcaaaagttaagttatggaccaaatcccatagcgagcccctagtgactttctgtaggggtccccataggtgtatgggggtctctatagataatatatgtgctgtgtgtaattttaaatttctccaaccgtgctgtacaaatgtgtggatttgtaatcaggctattttgttgttgttgttgttgttcagagccattaatataatatttaaagttgagttcactggataagtttttcatcttgcccaaccatttctaactgccaaattgaattcaagaaaccgatgtgggttttgtttcctgtacaattatgagatataattctttttcccattgtaggtcttttacaaaacaagaaaataatttatttttttgttggtggataaagaagtcaagtatctgatactttttatttacaaagtgtgatggttttgtatagtaggttccaccctgagtattcctaaaagaaa

SEQ ID NO: 90107 - DNA, 372 bp, Homo sapiens
tccatactggaaggacaaggggaaacagtgttctggggtgaaaatggagaacgaagtcctccggggcagtttttggtgttcctcttttactgtttaggcctggtcagctctggtcccaaacttggacatcccagctcaaccaaacctcaccctgacactacctgcctgggtcctctccttacagtgcagttcagtcactgtgccattgatcaggtcagcccttggggtcttaccactccccggtgtggctactaaggtactgacttcctttagactattttttaaacaatgcacccctaattacacttgagatattttagaatcttggtagaatttgagcaccctacaatatagctcccagcctggcctgcc

SEQ ID NO: 90108 - DNA, 314 bp, Homo sapiens
agttgacttggtcatgcagctattaaatctcagaaccaggactagaacctaggttttctcattaacttttttactatgagaaagttgcagggaagaaaacaatatcatacattccctggtaaattgttaaggattcataattataaatgctttacctttccagaatggtggttataagggatgtttttgtttagcaggggacttccagagacaaaaatattgagcttttttaacatttaaaaaattaattacattttaatcttctagacgtaatttcaggtaccatgaacctgtgagggagacacttttaatta

SEQ ID NO: 90109 - DNA, 428 bp, Homo sapiens
aacacatccaattcctttggacaactcctctcaccttgctgcataactttattacattcttcactgatgtgctaggtcagtgtttcctgatagaatccactgtggtctgtggaacacatcatgatgggaatgcccattcttaacacctttctccacccactgcacactcatcctttaccagtaagatatctatctatatcatactttccagaagagaaaaaacattagtattactataggcacacagatctatatgttaaggttcaacttaaataccacttcttcctagctagacataatcttttcatcttctgaattcatgtaacactttatctgtatcattcctatttcatatagggctttaaaatacctttatcagagttatctatatacatttgatctctgacactacttggacaggtttttag

SEQ ID NO: 90110 - DNA, 279 bp, Homo sapiens
tcctgttactccatcagctgctttcaacgctaagaccctgctcacctccacagccaatcccaagccacagcccccttcagcagtaccatgggatcctgtggctaagagagcaccctggatcacgccccctcctgagttccagggccccaccctctgcgttggtgtggtgtgtgacctggtggctgggaaatacccaagttgcagctggatatgcttttttttccttctgagacagggtcttacgctgtccctcaggctggagtacagtagtatgactat

SEQ ID NO: 90111 - DNA, 412 bp, Homo sapiens
ccagtaatcagcgtaccgtctgagcagctgggaagggcctcagaatccctacagggacagctttaatgctctatgtttagtcaggcaagctcctttctttaataacaatgaaaccaagcttgcaaaatccctgaatggaaagggcctttttttcagggaacttgcagactatttaaatgagttaaagatgaaaaacaaatataaattcagctccttagtggtactagccacatttccagtgctcagtagtcacgtgtgcttagtggctgctgtactggatggtgcatttccaatatctagaccacttctgtcactgcagaaagttctggacagtgctgaactgcagaaggtcttctggctccacagagatttttctcagggtcttccatgatacctgaattccagatcttgg

SEQ ID NO: 90112 - DNA, 239 bp, Homo sapiens
tgatctttttcatttaacagcttagtccagtgccttgcctggactgccactagctgtcttttggtctagaagaagccatgagcaggttccaattgtattgcttctaaacacttgctgactgtcaaaaagaccccatccctttggggacataagccctagagttgagagcacccacaggattcacgcttccctgactctggggttccctttagggctttaccagatggaaaactagcacc

SEQ ID NO: 90113 - DNA, 459 bp, Homo sapiens
gagatccaagtgtatgttcagatttagttggaaagagtttagaaagtagctggattgcgtcactgcactccagcctgggcgacagagcaagactccgtctccaaaaaaaaagaaagtagctggaaagcggactttcagctccagagtagagtaaaaattttaaaaacaagaaaaaggaatatagtacactcaggaacatgtaacttctggtcttttaggaagctgcctcttttttctttttctttttgagacggagtcttgctctgtcacccaggctggagtacagtggcatgatctcagctcactgcagcctcagccccctgggatcaagcgattctcctgcctcagcctcccgagtagctgggattacaggcacacgccaccacgcctggataatttttgtatttttggtagagacggggtttcaccatgttggccaggctggtctcaaactcctga

SEQ ID NO: 90114 - DNA, 395 bp, Homo sapiens
atgaaccttgttccctaagggtaatttaattgctttactattagattggtgcaaaagtaattgtggcctttgccattactttccatggcaaaaaccgcaattacaaaagccgctactttcaatagcaaaaaccacaattacttttgcaccaacctagtatttagtatggatcctcacaaggtttttactctgggtactcaagcgtatgtatatccaggcatactttcagggtgttttatttgttggcagcaaccagtatttcatagtaagaaccataacttaactttcctgtgggtagattttggagttatttcatggagatttttactagtccagactctgcagtgcaggtgtcttttgtgcacttgaccaggtgttgttacaggattaatttt

SEQ ID NO: 90115 - DNA, 394 bp, Homo sapiens
atgggttagggttaaagttttgtgattctagctgttgacataacaaaccagtgtctgctagtccagatctgccaacacttatcaggactaattaccttgaacactaggtgatagctggtgtccttagagttgtgtaagaagccagcttccttttaggatgccagtttgcagcagatcagtattttaacaaccttcctgttaacctaaatatttaaaggtattactagattctggttacacattttgtcatgggtgatgatatatatttcctatggtatcatttagtaataatgtcaagttgtttcagtattaatgacactaaatttgatcacttatggtgataatagtcatatctctcttatagagatttgctttggagttagtaagtcctgtc

SEQ ID NO: 90116 - DNA, 861 bp, Homo sapiens
aaattgttaccaaattctttataggaaggagagtgcaaaattatgtaaatgatggtcaggtttactgtgttatattaagcaatttaaagtgataacaaaatgaaaggtagtgcagcaaaataatataactggtgagtagacctactttcagttccatagggtgtttgtggcagaacacagtgcagaacaggaggaatattacattttttttcaaatttagaataattatgtccatcaaatgtttcttactgaatatgtctatcaaatatgtttcttattgaatatttctatcaagtgaatccacaatttaaaagtcactttggttttatatatacacacatctgcagatataattttataagaacacacaaatataatcctgtcattcgtactggtttccatgacatagtatcttgttttctttcattgtggtacaatgcaaagtagccacagattcctcccatcccaagtagcgtctctttgtctactacttgactttgaacttggccacgtgactttctttggccaatggaaattagcaaagagaatcaataagaagcttgagaagtgtgcaaagcctgccttgaagcttaccctctcttgctgctctttgcaaacctgaagaatctcaaattgccctactcgggggtgaggagccaccacatggagcagtggtgagccagccttgctgaggccccttagaccaagtagcctgccaattgtcagaattgggagtgaggttttccaagacctctagccccagctgagccagcctagcccagaagagccataccagttattccagctgatttacagaattgtgagataaataaaatgatgatagttttaagcaacatgagt

SEQ ID NO: 90117 - DNA, 422 bp, Homo sapiens
cgctgaaaaggatttcggattgcttgcacaatgggtacattattgaatgcctctgtggaagggcatgataaagatgaaaaatagtgacggtggtaatgcctaaggtggagaaaggaggagcgtggataaacgcagctcggaggcctctgtgctgcagtgatatgcacattatttagcagcattccaatgatttgcttgtaatatggaccagagggcccagaaaaaaatgatttccacaggatgtcatgaatccaaacttcaattattggatccaatcagtggattaagtgcaccccctttcagaactgaaccttcaggttgtaaactaagtttatgaaaggacatccccaggtctcaccccacccttgttctggacctattaactttttttctgtttgtttgttttttgttttgagatggag

SEQ ID NO: 90118 - DNA, 340 bp, Homo sapiens
gaattgtgtagttaaaaatcttgtaacaaaactacaggcccaaatggcttcactaccaaaagccagagatcaggacaagaccaagcctttctcagtgccaggaggaatgcttgagcttcaactcccagttcccacctctgttatgcttccagggattcccaaatattttgcattctgtggtgttcacacctcaattctatctcacagtgctgacctgatcagttgaaaggtgctgttgcacgtaagagtgacctttgcatgttgggtgaaagggaagcctcagaaaggcagtaatttgagccagtggtagacattctttcccaactcaaccttgccaagg

SEQ ID NO: 90119 - DNA, 249 bp, Homo sapiens
cctttctgtctcttttccccctctttctttcttttctagctgcggcttcatgctcccatttatgaaataaagattaaattagcagggtagaggaccctaaagccacactgactaacattgctgttgacttaataatattttggccccagtgcaaaataaaatctttcttttcaaaaatcactatttcttatacaattgtatacttttttgaggatcttgtcatgagacttcatttggagatttttctat

SEQ ID NO: 90120 - DNA, 200 bp, Homo sapiens
agaggctgaggtgggaggattgcttgagcctgggaggttgaggctgcagtaagtggtgatcatgccactgcactccagcctgggcgacagagcaagactctatctatatatacaaaaaaaaagaatcctctggggcctgtaagagcagggcccaaggagatggctggagctgaggagaatagctatggttgtgccactgc

SEQ ID NO: 90121 - DNA, 498 bp, Homo sapiens
cactagtaagtggcagagctgagctgaaatttaaacttaagttggtattactccaaagttaccttaactactcatctgtggggcagttagactgagagtgaagttgacatcttatgagagttgaagtatctgaggaagataaacttgatgttctacagaagttgggggaggaagttctccaaatcagaatcaagtttttttctcaagcaatgattttaggacaataccaaatgtgtgatacccataccaaatgtgtgatacctatgtattgaatttatgacagagttaccaacgttctactttggacaattaactgaaaattttcagtctaaaaacataatgtggacatttataattatatatacatacatgattcatttgcttttcatcttttttctttactgaattatagctttagcaaatatctattgaatttttattatatgtcatgcatgatacctttaaggaaaaatatatatattccctttccttcccatt

SEQ ID NO: 90122 - DNA, 511 bp, Homo sapiens
aggcaaaacgattacccttgggtcagaaagaatccaaaacctgactcaactcactgatcatctgaatagctttgccactttgaatgcccacaaaaaccctgggagagagggatctggattctctctggacagggagaaaacagaggctgggagagggggagttgtttttccaagaacatgcagccgtctgagctccctgattatcccacaactcttccgggctctcagggacctgccagtccagggctctcaaacctcttagtgtcaaaacaccctgcagtccaagtctcttcaaagagtgtccatgagcctgggagacataatgagtccccgtctttaaaaaaaaaattttaaagtagcctggtgtggtggtgcatgcctgtggacccagctatcgaggaggctgaggtgggaggatcccttgagcccgggagttggaggctgtggtgagttgtgatcggccactgcactccagcctgggcgagagtgagaccctgtctcaaaaaaaaaa

SEQ ID NO: 90123 - DNA, 447 bp, Homo sapiens
agctatgggttacaatctgaagtgtaaagtctctatctccaagtgttgataatggagtaagcaaaggtaattattctgtttctaacaagtgtagatttggggtgggaggaagacctatacaagaaaatcgaagagatgagtcatgtttaaagaaagttggtttcttggcattctagaaaaataaagccttaagagcatgaaaacaagctaggttgaatgtctatcccagcccctgcctgctatgccaaccctcaacctccccctagtcttgtgcaaatagctggtccaggaaacccaatgcattcaaatatgagcggcaaaaaagcgatcatatgcacaccactgacagatcaattaaaaaagaattgagggaaaaaagaggacaatggcagagaaacagaaaagtcacagaaaaatgttgccattggagcatacgaaatttctggc

SEQ ID NO: 90124 - DNA, 484 bp, Homo sapiens
cttatgtaggcctaaaaacctctgaaatgtcatttcttggattctacaaaacatgagtttggatttttttgaatgaaaaaagttccatttagtgaacagcacatcacaaaggtttttcactgatgttgttattcactctgcctgtttgctgctcagccatgattaagttcgttgcatacagcttataacagagaggcagagggaaaagataaacaccaggcctgagagagagacttgctgagataattgagcaagggctggcagaaaggagagaagcaggaggtcattaaagaagaccatcgtctttggggtttgggaattggcacaaggcatataacccactgattctctgatgtgtgacaggtgagtagctcaggccaagtgactggcttcctcatccatctggtctgtggctgagctgggactacagccaagtttccacactctgtttaaatacctaagagaaagagatcaccctgcacgg

SEQ ID NO: 90125 - DNA, 463 bp, Homo sapiens
ccataactatttaaaatgtgagcagattatcagatttacttctaataaagttaatgtacctcaattatgttatttggtgaaataactctttctggccttgaaggtacaagttggtttttgttgtttttgcacttgcgtcagtatttctacaggactgacattctgaagtgaaatttcatgatataaaaaatgtgctactgaaattttttaaaatacacaatagctttccaaatggttctgtgcccatttttgtctctgccagttcatgaatgtgtatatcaattcccccatgcactctgcaatattatatattacgcatctttttaatcttattaatttctgctgagctgataggtgagaattatatctcatcattttaactgccctgcacttcttaaagtctcaggcccaagaaaaatgcaaagaaaagttcatgttcactcttcagttggcatttttgcct

SEQ ID NO: 90126 - DNA, 255 bp, Homo sapiens
tgccacatttattgtgactatactttttaaagagtcctttaaaaagcaggacaatacccatttccctgggggagaccacgaacatacagctacaggatgaatacagaaaatgacaatcctgattatgatgccaccgagttcttggagctgagaaagagatttctagaaacctagattttaaaagtgctttatctcaggcccttagatagaagcaaagatgatgaactctggaaaactcagacaagtggctcaagt

SEQ ID NO: 90127 - DNA, 464 bp, Homo sapiens
ttttggcttttcttccaccttagatctgatattcaaggcatattagtgactctaaggcagagtaattaagctgacaatctgtccatgtggtagaagcatgataaaaagctttaaaatgacttggtctagaaaacacaggtatggaaatgcttggcaatttccgtagcacaaagtaacctgatgtgtcacacggtgaagaagcaaaaagcaagctgagggatgataaactcacaccaaccagtctgaaagcaaaatctttctgcttccacaaaccgagtgaaaagaactgtctccaactttaatcactttagaggaagagggggcgtagctgctgtggatttttaagatactgataacaccactaaagttttagaagaccaatccctgttgaatagctagttaaagtttgagaacaaatgtcatgtttttattgcttataggaagaccacaactaattagcctaa

SEQ ID NO: 90128 - DNA, 267 bp, Homo sapiens
gtaacacctggaaaagtctaacattttagagagcatgaaagaaaggaggtcaagccaaggagagagacacaaacaagtttcaagaaaaaccagaagagtacattagccaaaggtacatgagaacgtatttcaaggagacaatgtcatatatttgtcaaatgcttctgaaaggtcaaagaggatgaagactaagaattgattattttatgattctatttagatttgggatgtaaattgattgaaactaaaattttttcatagattctt

SEQ ID NO: 90129 - DNA, 176 bp, Homo sapiens
aattgctgtgagtcagtgctattccctttgctgaaacacccctgatgtaagccagataatatgctgggtttgcaagatttaagaatggtaactagagaaagggaaaatattcctcctttaaacctagcaattctcccgttttcctcccttttgcaaaccctatacttttggctact

SEQ ID NO: 90130 - DNA, 1729 bp, Homo sapiens
gtctcgctctgttgcccaggctggagtacagtggcgcgatctcagctcactgcaagctccgcctcccaagttcactccattctcctgcctcagcctccggagtagctgggactgcaggcgcctgccaccacgcctggctaattttttgtatttttagtggagacggattttcaccgtgttagccaggatggtctcaatctcctgacctcgtgatccacccgccttggcctcccaaagtgctgggattacaggcgtgagccaccgtgcctggccgacatttttaaaaaagttttattttgcacggctctaaacctccatgttattttccagtggtgtagaaggtaccagctaaagtgaaccactatgtaatattaggccattctaaaggaaagatgttccatgtcatcagagatggtaaaataggcagggaaaaaaaaatctttggtaccaaagattacacttgtgtttctacacagcaaaccatttttctttcatgaaaataatatattattaacatgaatatattattttgctattaatgtgaaagttgtctctaaatattttttaattttcaaactcatactttattttcatttgaaatgtttttcacaccttttgcattacataataattttgtggaagcattttgccctttagaataaatattagattgatatagctgaaatgtgacttccagttctttgatattccccttgttattcaaatagaaatatggaaatgctttatatattactgttaaatttcttagtgcagaaataacattattaatagagtattgttttcaaaacagatgattaatttcaagaggtttaacagtgaaattgtgtcaatattttgcatttaaaatgaatttaattgaccgatattttctgtagttaaatttagtcacaatatcacatatgttcttcaagaaacacatgaaattattaataaagtaattaaaaaatttttaatgtataacagaattgaccaataggccagttttctggtaacttatgatagtagattgtttctttagaaactgggcagaagctctgcattctcacttgtactttgatttcttatttcttggtcaggcaatttgaggaaagaagaaatggcatggggaatatatatgttttgtttcttagggaaaacagtctgagaaatgaataaaaagcatgaagtacgtgtgtgtgtgtgtgtgtgtgttaccatggaaaaggatattcacagtagtacagttctcaatatttttaattagatgtcatatttttttaatatagtaaaaccttgggatatagaatattacatcttttgagaatgtatgtgtctctaagtaagtaaaatctaatgcgtataggagactgatagctaaaaatgaatggaacattaatgtacttttataattaaacctcttatctatcagaaattgtaagagaatagatacatgttttgaatgtaaagttgaaaagtctggtttactgaataaattgaaagtgatttataaaatctaaatttggactacttgcaaatgataagctattctagtagcctttagtttaaatccaacagaaatctagaagtcacaagcaaatatcttaaaggtaaaatccatctgggcactcatttaaagtatatcttaaaaaagcagcagcaaggtaccttgccatttttagcatattttcttcctttttcttttttcttttttttttttttttgagatgga

SEQ ID NO: 90131 - DNA, 1509 bp, Homo sapiens
gtctcgctctgttgcccaggctggagtacagtggcgcgatctcagctcactgcaagctccgcctcccaagttcactccattctcctgcctcagcctccggagtagctgggactgcaggcgcctgccaccacgcctggctaattttttgtatttttagtggagacggattttcaccgtgttagccaggatggtctcaatctcctgacctcgtgatccacccgccttggcctcccaaagtgctgggattacaggcgtgagccaccgtgcctggccgacatttttaaaaaagttttattttgcacggctctaaacctccatgttattttccagtggtgtagaaggtaccagctaaagtgaaccactatgtaatattaggccattctaaaggaaagatgttccatgtcatcagagatggtaaaataggcagggaaaaaaaaatctttggtaccaaagattacacttgtgtttctacacagcaaaccatttttctttcatgaaaataatatattattaacatgaatatattattttgctattaatgtgaaagttgtctctaaatattttttaattttcaaactcatactttattttcatttgaaatgtttttcacaccttttgcattacataataattttgtggaagcattttgccctttagaataaatattagattgatatagctgaaatgtgacttccagttctttgatattccccttgttattcaaatagaaatatggaaatgctttatatattactgttaaatttcttagtgcagaaataacattattaatagagtattgttttcaaaacagatgattaatttcaagaggtttaacagtgaaattgtgtcaatattttgcatttaaaatgaatttaattgaccgatattttctgtagttaaatttagtcacaatatcacatatgttcttcaagaaacacatgaaattattaataaagtaattaaaaaatttttaatgtataacagaattgaccaataggccagttttctggtaacttatgatagtagattgtttctttagaaactgggcagaagctctgcattctcacttgtactttgatttcttatttcttggtcaggcaatttgaggaaagaagaaatggcatggggaatatatatgttttgtttcttagggaaaacagtctgagaaatgaataaaaagcatgaagtaaaaaaaaaaaagaaaaaagaagaaaaaaaaaaatttggggggggatgtgggccctgtggaaaaagtttttaaaacaatttgttttgggggaggggggcccaggaaggtacggtaaccgatggtcaacgggtgatccaaaggaaaaacggggcaaaacagacgaggcacagcagaatctcgcacgcagtaagaagaagcccggggggaaaacggaggctttccgcaaacatctcaagaagggacatccgaagcacatacgggggacctacaaagaggatctcccacagaaaacccgctaacaaatagacacgcagttgggg

SEQ ID NO: 90132 - DNA, 430 bp, Homo sapiens
tgcacagtatccaaacagggaattgattttatcataagcactgatcgttggattattcagccaaataaaacattatttctttagatacatctgtgaactccccatattaccactgaaaggtcatgaatcttaatatgtttatgagtatggtctataaacagatttatgtttcatatttcattctctgcaggggaaaagttttgttctctttaaactgtttaatcataatgtagtaattgcacaaaaattcaaaatcagagtctgattttaaggtttctgtgaacctgagccattgggtttggtttttctgtttttgagcccgttaagtcactgcatttaattgtaaaatctcattttactagtcaagcacataattataacaaaaaaattgagtacataagtcatacagagccctggctccttttctcaa

SEQ ID NO: 90133 - DNA, 463 bp, Homo sapiens
actgcactccagcctggatgacagagggagactccatctcaaaaaaacaaaaacaaaaacaaaaacaaaatatctacaaacaatcagtggagtatacctattgggttgctatattttttattttatgttttcaattgtttttggggagcaggtgatttttttgttgtgtgggtatgttctttagcgatgatttctgatgttttagtgcacctgttccccgagcaggcatacgttgtacccactgcacccaaactcatagctcactgcaactcccaactcccaagcaatcccttgcctcagccttccaaagtgctgggatcgtaggcgtaagccaccatgcctggctccatgttttaccttttgaagaactgccagactgttttccaaagcagtgaagcacacatttttgcagtaaagcaagaaattttataaatgatatgccctttccacaagttccactttt

SEQ ID NO: 90134 - DNA, 231 bp, Homo sapiens
caaagagcatctattctaagtctggactgaaaaaattaatgtgaggacaattagaagagaaaggccagcggaatggagtaacccagcctgcctcatacaactgtcacgggagtccttcccaggtctcagaggggacctcagggctctcgcatgtgcatcacggcaccctcatgcacacacacgccttcagagaccgccagtgcggctttccacaaacataccaagcactta

SEQ ID NO: 90135 - DNA, 2254 bp, Homo sapiens
aggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattgg

SEQ ID NO: 90136 - DNA, 2599 bp, Homo sapiens
aggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggaaaaaaaaaaaaaaaaaaaaaaaaacaaaaaaacaaaaaaaaaaggggggggccaaaaaaacccagggggggacaccattaatcagctcaccgattttttgttaaaccaggaccccattaggaggaaaagttaataaaaaagaacaggcgacgttcacaacgcgtgcacgaaaaacttcttctggcttcgacaagacacccttcttggtggtactttgtcgaccacccaagaattaagctggcaataaaattagattatgttaacaggacatgccggcatctccgttttaatcgcacataatacaagagaaagtctctaatgagatcactgtactacggccaaga

SEQ ID NO: 90137 - DNA, 2199 bp, Homo sapiens
aggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacggcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattgg

SEQ ID NO: 90138 - DNA, 298 bp, Homo sapiens
tagagtttaattctgagtctacatgtcgtgagtctattggaagaagcttttcttaggaggtgaaatttgggatggagttctcctctacactctagccctgtagccacaatctttggtttagatctttggcattttttgttggacatctttcatagtgtctacctcttcttcctgcctctaggcttcccgcggttgccagatgaaattccgaaaactcaaatcattcctgtagttaatattcttcagtgactccggaacaatcaaattcttgatccctccacatgggtcttaccatctg

SEQ ID NO: 90139 - DNA, 239 bp, Homo sapiens
ccaaaatatcatgctcttcagtcattacttaggaattttctaggggtggaggaggtcaaaccaagaacttttacatttgggagattgaaatctatttctaaaacttgattttggaggttcagctccattctggtggtcactctctgaaaatgcccagcactttttctgtagatggctgtcaagccacatctcttgcagcctggccacaggcaattggattttcagtgctcagtgcttcc

SEQ ID NO: 90140 - DNA, 228 bp, Homo sapiens
cctttaagcttttatgtcattccaaggctacattaagagctcagcttcttggcaactatttaaaaaattggacagcttcattggataacgttttctgtctgtttacctactcctggaagccttgaactgcttaatcagtttagatgatccattcttagaaatgttgaaacaccttgacatgtcttcccctagcaggcatggtgagcactggtctgcaatttggccaaa

SEQ ID NO: 90141 - DNA, 257 bp, Homo sapiens
ccacagtcctagaaacaactgttccaaggcaaggagttcacttcattggggaagccaaaagggtggaggtcccaaaaagttttttgccaatttagtttctcaaactgagaagttcaagagaggaggctgtctgggaggaggttgggaagtcagtccatacattcgaaacaatactataggtgcctacttttaaaacaaggaaaagaaggaaaactgagagtgacaaaaggaaatcagtatgaatgggatgtgctcgg

SEQ ID NO: 90142 - DNA, 317 bp, Homo sapiens
gtatcactacatgcattttcatcatcacccgttataccatggtaaggagggcttggctcatctattttcattaaaccatagtctttgtctgctggatgatatgttgacaggatgttcatttcatcacacttctggcattttttactcagctcctcgtggacagttctgcagggctgttccgacaacgccaccatagaggaagtcctggaggtcttgttcttcaggatccccttgatgggctggtgcgaggctgccattgcccagcacttgggctgtgggctcaaggtccgtgaagagaagggtcgggcgctagcaga

SEQ ID NO: 90143 - DNA, 213 bp, Homo sapiens
gggtgcccatttctggaggtgcccccccgaagaggctggttagatggggacccaaggggaggcctgaactgccacgtcctccggtattgtccccttcccctctactttctatttgcccatcttcctaattagagggaaaaaatctacactcacttcctctattcaacctttcacttaaaaaaaaaatgcaactcccacccccctggttcccag

SEQ ID NO: 90144 - DNA, 183 bp, Homo sapiens
atatgtataatctggagaaaaaggaaacagaatacatggaaacaccaccaaatgggaagtccaaaggctctagtcactcactagttatataatcccaaggcaaactactttacctgcacagcctcagtttcctcaactgtgaaatgagggatgtcaactagagtctttccagctctacacagc

SEQ ID NO: 90145 - DNA, 662 bp, Homo sapiens
gccttcctaaagaagtaactgcaacttttaaaacgtgatgattattggtttttataatacacaaagcattaattttttcttatcttattttctctttattatttctttccaacttttgtttggagacatttatgttagaagaaaaactataaagttttatcattgtagagaacagagagatcaaagacagctggactgtacctgtttgtgtaattatttctgatatttttaggaaaagaagtttaacagagtaactcagactgagactgttaaactctgttcatgataaactccatattacataatataggtgaacagattaattccctccatgtaactaagatactctatttacattatttatatactctcttagttttttatgcacttccaagttttagttggaaaaatgaaaaccaagctactacttaaaagttattaaaaacttcacataaaatatttcattttagctacaagttattcattgcataggattttataaatagtctgggtatttcataggaactgcatttcaaaagtgaattaaccaaacctaaaaaaagggttacttttaaaatgcattaaaataaagaagtttcatattcagttgataaggccattaaggtaggataatgcagttacatatacaaactaaaaaaaaa

SEQ ID NO: 90146 - DNA, 560 bp, Homo sapiens
caaagccaaaagccacatctagacaggctttagatcctgacagactatgggtctctacattggctggcgctgcccccattacctatgggactgtttccggattggggatgagtccagatgcttttgtggacacttgttgagagagcaccggatcatctcagacatatcggtgccctgcaaggtaagccagtgccgctgcttcatgttctgctttatcccatcacgcccagaggaggtgggtgagttctggctcaagagacgggccacctttgaccccaaggcctggagggcccaatgtcgctgcaaacacagccacgaagaacatgcagccactgggccccatccctgcaggcatcatggctgttgctgcggctgttttgagtctaatttcctctgtgcggcctgtgaccggcgctgggaggaacacgagactttctttgacacccagaagacccggcaacgaggaggaaggcctcgcgggacagacactgtcagcaactggcacaggcctttgtgagtctggcccagatcagcaataaaagaggagtcattggaaaaga

SEQ ID NO: 90147 - DNA, 342 bp, Homo sapiens
accggcgctgggaggaacacgagactttctttgacacccagaagacccggcaacgaggaggaaggcctcgcggtgaggcagaaacctgggacagggggccattccagggtctgtagtcagaaggccaggcaggaaggcactcccatcctcaaccatcccttccaggactagcgcgctccctcagcccacctccccaccacccacctacctgcatcccacatctgcactggttttcacccccaggagcagactatgtaccttttgcagagatggctgtgctccgagaagccatcctcagcaactctgacttctaggccctgcagatacaggggccctctggcc

SEQ ID NO: 90148 - DNA, 323 bp, Homo sapiens
gggaagtatcacgtgtatgcatagcatccacacacgtttttgaacacacttcactaatgtaaagtttggaagcattcaattccaccaaccctccataagcccctttttggaggggagcaagattctcatttggaaacaggattttagacttagtaacataagcctttcaagagacaagatccccttcaaaagtatagacctgtccccttcagttacaaaaccacgataacactacaaataaaaataatctgtattcggttgtatgtaaaacgttctgagttgttcacttggtagaaaggcacatagagacatagtcatcatat

SEQ ID NO: 90149 - DNA, 274 bp, Homo sapiens
gaggtagcggggttgcgggatttggaccgcggagccggattctgcccagagatgtgggcccttgaaagctggctggcacctggggcccagggctgagggtttggctttgccctcaaatcctggttgtgcgccctgcacactggcggacccttcaagtcactttacctctcccacctcaccttcctctcctgtaaagtggggttactatgcctgtcggaagttagaggcctggcagtttctctccgagtccagtttgcccctcagctcctcccgt

SEQ ID NO: 90150 - DNA, 423 bp, Homo sapiens
tgtgccacatggctctctgctcccctgtgtgatggtcagcctatgccacacacgtgcaggtgacttctggtgcccctctcggccctggtggagaccctcatttcctattgcccatggctgcctgctgattcccttctctgttctttggtcatgttgttctttgcatccagcgtcaaacacaccctcactctctgtctaaattccatatccatcctcccatactcagtacaaagaacttgtcgtatttctcttctgtctttacagagcaatctctccatcccctgaatcctcactggacttagtagaaaatccactgtggttataatgtatgctgccctggccctccagggacttagttcttttttttaagcattcccatagcatcctttaacaccacccccaccagcttttgaagttctaata

SEQ ID NO: 90151 - DNA, 362 bp, Homo sapiens
  misc_feature (174)..(174): n is a, c, g, or t
  misc_feature (299)..(299): n is a, c, g, or t
  misc_feature (329)..(329): n is a, c, g, or t
  misc_feature (331)..(331): n is a, c, g, or t
  misc_feature (338)..(338): n is a, c, g, or t
  misc_feature (359)..(359): n is a, c, g, or t
  misc_feature (362)..(362): n is a, c, g, or t
cacccctgaggaagagctttaatgtcactagggattcacccttatgacacaaacacctcctgcaagtggacccaacattgggatcaaatttcaatattagatttggagggaacagacatctaaaccatagcagaaggaaagaggcaagaaagtagctgcaaaagcatatgggcncgaagaaggagttgaaaacaaacatgtttaagattgtgagaaggtgctagctgacagagaaaagtcgcatatgcaaaaaacacaaagcactaatggaaagttcctgagaaggttgtgacaagggnggaattttgtgacttgaagcccagttaggngnattatgngagatggtgtgaggacagctnctn

SEQ ID NO: 90152 - DNA, 258 bp, Homo sapiens
caaatattttaaaaatctataatcatattaagttgggatttttttccaaaacaaagttagtaaagtatcaaattaaagtagatatcattgtgagacaaattttattatgtagaggcaaatttagacattgtaaagggaaaattttactatatatataaacttataaagatcaaaaggtttttatccacatattaagcaatttgagtctggaattaaatattgatttgtttttgttttagaaatttgaaaatccctgaa

SEQ ID NO: 90153 - DNA, 194 bp, Homo sapiens
tgttgctacttaaaactctcccacagttttctgtgtcacctaaaggaaaagctgaagcctgagggccctatatgagccaatctgccaccccaccaccttcaaccctctttccctctctgaccttccacccagccctcttccccagcccagccctcttccccagcccaggggaagcaacaccctcttccacccag

SEQ ID NO: 90154 - DNA, 484 bp, Homo sapiens
cgcccaccaccacgcccagcttaaatttttgtatttttagtagagatggggtttcaccaagttggccaggctggtctcaagctcctaacctcaggtgatctgcccaccttagcctcccaaagtgctgggattaaaggcatgagccaccacgcttagccaataacaaatattaatgtattccttttctatcatttgttctgctggtctgttaaatgcctatctctaagggtggtagtcacgcacaaacagaagaccacctgggtggaccttatggatctctcccttttttgtgctatgaactcctttggaaatctgtcaaatgccagggacatacttcccagaaaaatacatatatctggaaactttcctattgcgtttttgagggtttcccctggtgtccaatcatgctgaaggacatggcatgacttcaggaacaccaacaaagatccaaagctttaaaatgccctctcctgccaggtcagct

SEQ ID NO: 90155 - DNA, 165 bp, Homo sapiens
agccatgcacaagaacattcatggcagccgcatgaacaaatatctatcaacaggaggagggataaacaaactgtactacatcttatatcactgagcatttttatttttatttttttgagacgtagtttcgcttgtcgcccaggctgaagtgaatagtgtgatctc

SEQ ID NO: 90156 - DNA, 452 bp, Homo sapiens
ctcaatctcttgacctcgtgatccacccaccttggcctcccaaagtgctgggattacaggcctgagccaccgcgcccagcccaaactctcaattctacaagcaattttttgtgtccttattatgtgccaggcactggcaattttcaggcctgggagatcaaatgtgacccttgctcctgctctcagtgtgttcttcagccaagccctcccccaccaccactttcctgccttgtctcttgccaccaggcacctgggcatcctcttccaggaaactttggggatgaatgcccacttgccatgcagcccaactgctccgtgcctatcagatttctagctattatctgaattggttccttctgatgaactgtgaacttccttgggttacccaacaggggacttatggtccctgtcagttgaataaaagatgtattggctgtgtcacttatttgttc

SEQ ID NO: 90157 - DNA, 428 bp, Homo sapiens
aaaagacaagacagagactgagacaggaggagattgcttcagcctaggagtttgaatccagtctgggcaacatagtgaggccctatctctattgaaacaaaaaaaaagggggggggctaccctttttgggtcccctccctttgtatgggagctctgttttcactctattaaatcttgcaactctcttctggtccatgtttgttatggttcaagctgagcttttgctcaccgtctgctactgctgtttgctgctgtcacagacctgccgctgacttccatccctctggatctggcagggtgtccgctgtgctcctgacccagtgaggggcccattgctgctcccaattgggctaaaggcttgccattgttcctgcacggctaagtgcccgggttcgtcctaattgagctgaacactagtcactgggttc

SEQ ID NO: 90158 - DNA, 429 bp, Homo sapiens
gtaatacagtcctttgtctctgatccaggagtctcctatcttttgccagcgtccacaaaattgtgatagtataacttgttacattgcaaatagagtaaaatatcacaccttcacagttcttaagactactgttacaatgcctatagttccttgaaaaatacttcatcatagacagtgatatatgggtattatttaagggaaaccacaactcgagtgcatattccggactggatactcatgggtgctagtacaagtggttctgttattcatatcttgactaacactggaagctttactaattagcacagcaatgatcaaaatggacttttattggtagaattagatcttattaaatagcatgatgaatattaaaaatggactttcattggtgaaattaaaaatactcaagattgtggattggtagaatcc

SEQ ID NO: 90159 - DNA, 1640 bp, Homo sapiens
  misc_feature (1175)..(1175): n is a, c, g, or t
  misc_feature (1238)..(1238): n is a, c, g, or t
  misc_feature (1240)..(1240): n is a, c, g, or t
  misc_feature (1540)..(1540): n is a, c, g, or t
  misc_feature (1552)..(1552): n is a, c, g, or t
  misc_feature (1640)..(1640): n is a, c, g, or t
gccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggggcctctccaggagcctggggtgtggcccagcgagtgggatccactcacgagtcccgtctccacctgccctccccaggcggcgggagcctgtttgccatccacggagactgtgaggcctacgacacgcgcaccgaccgctggcacgtggtggcctccatgtccacgcgccgggcccgggtgggagtggctgcggtggggaaccggctctatgctgtgggcggctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggctatgacggggcctcctgcctgaacagtgctgaacgctacgaccccctgaccggaacgtggacgtccgtcgctgccatgagcacccggaggcgctatgtgcgagtggccacgcttgatgggaacctgtatgctgtgggcggctacgacagctcctcacacctggccactgtggagaagtatgagccccaggtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcntcccacatgccttaaggggaccgtggcccccaccagggacgtcctgcgccatccgttcacgtntntgcatccattccttcatgtctttatttagttgtttatttatttagttatttatcttattgagaggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggngcaggtgtcctncctgtcgtcgtctgccgtgtgccatctttcctggatcttgtagcggggcacacgcgtgcactggccccccccccgcatacgatccccn

SEQ ID NO: 90160 - DNA, 1199 bp, Homo sapiens
  misc_feature (734)..(734): n is a, c, g, or t
  misc_feature (797)..(797): n is a, c, g, or t
  misc_feature (799)..(799): n is a, c, g, or t
  misc_feature (1099)..(1099): n is a, c, g, or t
  misc_feature (1111)..(1111): n is a, c, g, or t
  misc_feature (1199)..(1199): n is a, c, g, or t
cctggtaggactttgcggtctgagtttgactcctagggtaagatttcagccattccgctggggagggcaggtcctggggccgggacgcctttctgtctctgctgagctgtggctgcggtcctggtgcccacagtgctgaacgctacgaccccctgaccggaacgtggacgtccgtcgctgccatgagcacccggaggcgctatgtgcgagtggccacgcttgatgggaacctgtatgctgtgggcggctacgacagctcctcacacctggccactgtggagaagtatgagccccaggtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcntcccacatgccttaaggggaccgtggcccccaccagggacgtcctgcgccatccgttcacgtntntgcatccattccttcatgtctttatttagttgtttatttatttagttatttatcttattgagaggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggngcaggtgtcctncctgtcgtcgtctgccgtgtgccatctttcctggatcttgtagcggggcacacgcgtgcactggccccccccccgcatacgatccccn

SEQ ID NO: 90161 - DNA, 351 bp, Homo sapiens
agaccctgtctctaaaacaaaataaaattaaaagagattcctgggcctggtaagcacttgcttctggtagtggtagaggacagggagatggataaccagcagccccaacccacttattcagaaaatgagttctgtcccctcccaggtcaggggttcctccgtgtggccatgctgtctgtccggtacgacaggcaaagccacctacgttcacaaatacttatttttgttgttctcaaccaagccaggagaagcaacaggctggtgccaccaagagatttgagcttgcaggctcatggctccagacactgctgcagggccccagtcattgtcctgcacacaacctcccccagc

SEQ ID NO: 90162 - DNA, 996 bp, Homo sapiens
  misc_feature (760)..(760): n is a, c, g, or t
aagtcagtgctttctgagatctgcttttagtgaagtggatcaatgatgaaactagccaaatctgagcatcagaagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctcatagactgttcctggtggtggtgggcagggggtcacctacaggcaccgacatgaaaaaatgtccaaatgacccagccaaatggaaaagcacattgtaaaatagtatggggagctctgttaataaattatagtcggtctttctattaactagtcccttcagaaagcatttattgagcacatactctgtgtcagacccctggcttacagggcatagatctggagcaggaaattatggggcactgtccttttcatcttatctattccttgaacgttcagagtatcatgatgatgtcctgtgctggggctgacaggctccaaacaggcatgcgaggtgcctttggaaagccccagggcactgtggccagtgttcacattggccaagttatcatgtccatccgnaccaagctgcagaacaaggagcatgtgattgaggccctgcgcagggtcaaacttaaggtttctggtcgtcagatgatccacattgaaactgttcctatgattaaagagaccgttatgaggtcagatgagaataagttggccgaacagtaaagttgtgctggtcatgggcaacttccatgggccacaccctgctggtgccacttttgtaagtaccagggaagctgatccgggttgct

SEQ ID NO: 90163 - DNA, 480 bp, Homo sapiens
  misc_feature (371)..(371): n is a, c, g, or t
aagtcagtgctttctgagatctgcttttagtgaagtggatcaatgatgaaactagccaaatctgagcatcagaagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctcagtgccgtantctctgtaaacttccttaggctaaagggctaggggctgccaactatggctaaaacggccttttctccctcgccggtttttttttttttacgttaactatccccacctaa

SEQ ID NO: 90164 - DNA, 1103 bp, Homo sapiens
  misc_feature (203)..(203): n is a, c, g, or t
  misc_feature (867)..(867): n is a, c, g, or t
gagtgtgagagtgtggtatgtgtgtggtgtgcctatgtctggtgtatacacgtggtatatgtgtgatgtgtgtgtggatggggtttgtgcatgtgtgatgtgtatgggatgtgtatgggatgtgtatgtgtggtgtatacacgtggtatctgtgtgatgtgtgtatagatggggtttgtgtatgtgtggtgtgtatgtgcganatgtgtgtaatgtatgagcatgtgtggatgtgtgtgtagatggtttatgtgcatgtctggtgtatgtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctcatagactgttcctggtggtggtgggcagggggtcacctacaggcaccgacatgaaaaaatgtccaaatgacccagccaaatggaaaagcacattgtaaaatagtatggggagctctgttaataaattatagtcggtctttctattaactagtcccttcagaaagcatttattgagcacatactctgtgtcagacccctggcttacagggcatagatctggagcaggaaattatggggcactgtccttttcatcttatctattccttgaacgttcagagtatcatgatgatgtcctgtgctggggctgacaggctccaaacaggcatgcgaggtgcctttggaaagccccagggcactgtggccagtgttcacattggccaagttatcatgtccatccgnaccaagctgcagaacaaggagcatgtgattgaggccctgcgcagggtcaaacttaaggtttctggtcgtcagatgatccacattgaaactgttcctatgattaaagagaccgttatgaggtcagatgagaataagttggccgaacagtaaagttgtgctggtcatgggcaacttccatgggccacaccctgctggtgccacttttgtaagtaccagggaagctgatccgggttgct

SEQ ID NO: 90165 - DNA, 487 bp, Homo sapiens
aatgtcccttctctcacgatgtttgctttcatcaattgattaattcacttgatatctctacagtaacattattctttctctttgcagtaaataaccattttgtggattcacactttgtgtaaatatcccattcctcaaactttcaatgtattcatttacttatttattttaccatgggtccatagtttcctgttttattcagtgtgacataatcctttactatcctaatttgttttgatgctcaaattgttccagatatgactagagggagcactcttactgcttttgtgtccttctgacatgttcccatcatgatcatgtttttagcaattccttactttttggcagaaaagatatttcaggttcatcttatactttccctgcctcagccccagaatcaggttatttcttcaatgagactgggttccttttagtgggcaatggtatttagaaaccaagatctgggcaccatgtgtgctcactgctc

SEQ ID NO: 90166 - DNA, 421 bp, Homo sapiens
aagcagagcatctgaaactcattctgtccctagagactgctggttgggtctggagatgtcacaagcactgacatgctgagcagaaggcccagcagggtctacaccagcagggggcgcagtggggatggagaccagtgtccatgattcagacatgtattcgggatgctctgtgtagccttggggattgggggagcacgctgaatctgtggaagttttatgtccttgtagcccagcacctccatccctgcctgctgactcagacctcaacatgtgtcccatggaaagcacgggccacgtatagaggctgccctgtgcaacccccaaggctcagctggattctcctttcccaggagagctcctctgcctgcaccaagtcagagcttgtttccacaggcaaacttggcggctatggcagaaggac

SEQ ID NO: 90167 - DNA, 363 bp, Homo sapiens
aatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacctcaggttt

SEQ ID NO: 90168 - DNA, 454 bp, Homo sapiens
gtgggatattactcagtaaatttttgcccagaccactgtcttggagattttccttaatgttttcttgtaataatttcatattttggggtcttaggtttaattaagtgtttaatccatcttgatttgattattgtatatggtgagagatagggtgtatctttcatccttgaaaagtatatctgcccttgttgggcctggtattctagcattgtcaattagatcccttttgttgataatgtttttcaagtgtttggtattataccttttctttatagttgatcaatcaattactaagggaggagtgttgacaactccaaatgcatatgtagatttgtctacttctccttttcactccgtcagtttttgcttcaagtattttaagtttctaaattaagtgcattcacatttaagatttttatgtcagccaggcgcagtggctcacacctgtaatccc

SEQ ID NO: 90169 - DNA, 214 bp, Homo sapiens
ctcactcaaggctcagtgtttaaagcgcaagttcttatgtctgagatcatgggttggagcccttgttctgtcacatagctaatataacaaattaatttaccttcctgggactcattgctttcctctgtaaaacgggaataataatgttatttatttagcagggttactatgaaagttaaatgaaataaggcatacttcctgccatgtattgcct

SEQ ID NO: 90170 - DNA, 588 bp, Homo sapiens
ccaaagctggagctcttatgaagtactttccccctccttctcccacctgtatcatgcaccagaaaccaccactgccaccacccgtgtctcctgcagaatcctagagaggtttcaaagtgatgagtctgtctctccatgttggtgaaccctgaaacagtctacagccaaaaaagcaggaaaagggaagacacaggaagccgtggccacctgcgaagaggagaagagtggactgagctcccagaacctgcgtgtgaggaagaagaagagcacctgggaagaagacatcggcatgaaactcagtcctgggccgaaggaggcacaaggttctacgtaggactccgagaatgatagctgctgaaaaacgggacaagttgtcctgggtgactccttcctgcaaatcacaaacatgcaaatcgaggctgggcgcagtggctcatcctgtaatcccagcactttgggagggcaaggaaggtggatcacttgaggtcaagagttcaagaccagcctggtgaacatggtgaaacccatctctactaaaaatacaccaattagccaggggtggtggcatgcacctataatctcagttac

SEQ ID NO: 90171 - DNA, 207 bp, Homo sapiens
tgttgggttcctgtgggcactttgctttccttttttggacatgatttggactgtttgccaagcctctatgaatcatcgcttcagcctctgactggtcccaggacaaggtcccaggccaaggtcctggaccaagctttcacttcagctcctgagtggtcccaggccaagctgagtaggctttctccaagaccagtcagcacattcctt

SEQ ID NO: 90172 - DNA, 389 bp, Homo sapiens
atctttgtaacacatcatgtgttatgcactttgcatggatcatctcatgttattctcacagcagtcctatggggggtggtactcttattatgcccattttactgatggaaacactgaagctcaaggaggataagtagctacccaaagtcacagagttaataaacaatacagtcagacttcagtcatgacgctctgaccctggaactatgcttttaacccctatactggtcaattaaactatgcagactgtaaacagggacaaaaccagtcgattaattagaacaattagtgatgaacaggtgactgaaaaatgttggaaggggtgttttgatagcatttagatgaagtgattggtctatatgaggatggccatttaggctgagacctga

SEQ ID NO: 90173 - DNA, 827 bp, Homo sapiens
ctagaagcaagtatataaagcagaatatatacgcattattctaaatgtatgctttgcagtaagaatcttgctattattgacagatctagtcatttagtactttgtaaactagctccactagttcctccctgtactttccttgaattactcactaatatatatgaatataaatatcattttttaaggattaaagaaattaatatatgtgaaatattgcacatgacagaaagaagtacacattaaagaactggtattatttaaaatgtttttattttataacttcattcagttacttttcttagcaaggtttaaataaaaatgacttgaatgcttttatccaccttgtatggcagtttcctgagaggactcgcattgtcttggtcacctctggctcaaaggccctgcctctgctcaagtagttaaattttctgaaataatttgtacaatgagatatcttctttcagaagaagtttggttctatattgtcttgaacatgccctgatgcagaactcaatattttttcaatgatcaaaaccaatgacaagataaacacacaaaaaaatacatttccagcctgagtacatagagtagactataacattagacagaactgttctttaatatcctttgatcccagccttccacatgacattcatggccctctatatagcattttgtaggcccccggcttctcatcaccaatcctgctgatttccgtgtttttcttttctttcattttccttactcctcctttccatatgactgtcagaaactccatttagttatttataactcccatattaagcctagctccacattctgctgtg

SEQ ID NO: 90174 - DNA, 542 bp, Homo sapiens
cccaatgggatgatagagctgggtcatgtggagagcctgagtccctgagaggatgatagagctgggtcatgtggagagcctgggtccctgagaggatgatagagctgggtcgtatggagagcctggatccccgatgggatgatagagctgggtcatgtggagagcctgggtccctgagaggatgatagaactgggtcgtgtggagagcctggatccctgacgggatgatagaactgggtcgtgtggagagcctgggtccccgatgggatgatagagccgggtcatgtggagagcatggatccccaatgggatgatagagctgggtcgtatggagagcctgggtccctgaacacaccatgccatatcacactgttggctaaactgttccctcagcctaagtcatcctccatgtgagtacaagattcatcactttgtcccagctgctctttctggactccactctcagttccctggcttcctacctgtcgatccaaatccattctttgctatgctggtactctgtcagtttctctctgcccttc

SEQ ID NO: 90175 - DNA, 1970 bp, Homo sapiens
tgacaaaaaagaaagacacctgttggggtggcctgccagacccaggagtggagggctctgtgagggcccgggaattcggactcaggacagggattctccatggctaggcccagaaacacagggtccaaccactctccagcagggagacctgggggtgaaggggtgagccctgcgcaggtctctgttccttggtcttcactgggcagtgtggagaggtgtggccaggaggagcccgcgtttgtccagaccagggtctactctggcaccagagtgaccacctctgacctctcctttcctcgtcctgggccgggaacgacaccaaatgagggacatggaaaggggtgagaagcataaatgtgcgtgtgtttctgcagaggagggggcatgggcccctgccgggctgcgcaggggagggtggggtgggacttttccagagagggagccaggcctggcccgggccccgggagctcacgtcacccccacccctcacttctccagggaactgccaaagccaaacccagctcgggatgggattatgtgtactgggtagacccgtggagaggggctgcgagaagagatctcggtggcagagagaagcagaggcagagagggcatgaagaggggtcggcatcagagaaggggcaggcagtgactatcaccccatttcttcttccctcagctggagtaacaagagtcaggcagagcctgaagacttgggtggaacatgggcccttctctggagatcctggcctcccccgttcagtcagggtggagttgctgaccttagtggccggcccagccaggggaaggagtggccatcggcaacccccaccccaaccccaatccctgaggcgcccgctctggctcagccactctgacccctccctcaaattccgaaccctaggtctcagggagggcagtggggctgagtgtctgcccccaggcacattcctacccttctcttggtcattttctgccccagagctggcccacctcagcaatgcgagggctccctggattcctctcccgggtgcctttcagatccaacagaaacagattttttttttcctggaaagcagaactaagagtgggatgaggagcaggggcgggaaggactcaaagtgagaagaagggggcaaagagagtcaggcttggtggctggggtggcttccaagcctcacttctccagtgttcaaagctgaacttcagatggacttcccggctcttcagaatgagaggcctgtggctggggcatgaggcagccccggctgcacctctccttcccgcttccccagctggtagagacgcacaggaaacaagccctcactgaaccaactccagatgctggcacccagagtgggtgttacattgccggcttcttctctagagattaaaccgtcaacccatttagcttatcccttggccaaaaagtgtatgagatgtgcctggatgttccctaaagagcttatctaagaagggaagagaaagccgggaggcaagtaggacagagagatgactggggaaggtcttgtgtctggaagacccaaggaaggggcttctggtgggtcctcagagagagtgtctggcgcatcctcagtggagccttcctcctctactttctaggcacctctgggagggcaggagtgggagcagatgacaaccattttagaaggagccctctggctgggtgcggtggctcacacctgtcatcccagcactttgggaggccaaggcaggagaagcgcttgaggcctggagttcaagaccagcctgtgcaacatgggtgaaaccctgtctctacaaaacaagaaaagtcagccgtgcgtggtgtcacccgcctgtagtcccagatactcaggaagctgaggcaggaggatcacttgagccagaggttaagtctgcagtgagctgtgattgtaccactgctctccagcctgagcaacagagccggaccctgtctcaccaaagga

SEQ ID NO: 90176 - DNA, 1956 bp, Homo sapiens
tgacaaaaaagaaagacacctgttggggtggcctgccagacccaggagtggagggctctgtgagggcccgggaattcggactcaggacagggattctccatggctaggcccagaaacacagggtccaaccactctccagcagggagacctgggggtgaaggggtgagccctgcgcaggtctctgttccttggtcttcactgggcagtgtggagaggtgtggccaggaggagcccgcgtttgtccagaccagggtctactctggcaccagagtgaccacctctgacctctcctttcctcgtcctgggccgggaacgacaccaaatgagggacatggaaaggggtgagaagcataaatgtgcgtgtgtttctgcagaggagggggcatgggcccctgccgggctgcgcaggggagggtggggtgggacttttccagagagggagccaggcctggcccgggccccgggagctcacgtcacccccacccctcacttctccagggaactgccaaagccaaacccagctcgggatgggattatgtgtactgggtagacccgtggagaggggctgcgagaagagatctcggtggcagagagaagcagaggcagagagggcatgaagaggggtcggcatcagagaaggggcaggcagtgactatcaccccatttcttcttccctcagctggagtaacaagagtcaggcagagcctgaagacttgggtggaacatgggcccttctctggagatcctggcctcccccgttcagtcagggtggagttgctgaccttagtggccggcccagccaggggaaggagtggccatcggcaacccccaccccaaccccaatccctgaggcgcccgctctggctcagccactctgacccctccctcaaattccgaaccctaggtctcagggagggcagtggggctgagtgtctgcccccaggcacattcctacccttctcttggtcattttctgccccagagctggcccacctcagcaatgcgagggctccctggattcctctcccgggtgcctttcagatccaacagaaacagattttttttttcctggaaagcagaactaagagtgggatgaggagcaggggcgggaaggactcaaagtgagaagaagggggcaaagagagtcaggcttggtggctggggtggcttccaagcctcacttctccagtgttcaaagctgaacttcagatggacttcccggctcttcagaatgagaggcctgtggctggggcatgaggcagccccggctgcacctctccttcccgcttccccagctggtagagacgcacaggaaacaagccctcactgaaccaactccagatgctggcacccagagtgggtgttacattgccggcttcttctctagagattaaaccgtcaacccatttagcttatcccttggccaaaaagtgtatgagatgtgcctggatgttccctaaagagcttatctaagaagggaagagaaagccgggaggcaagtaggacagagagatgactggggaaggtcttgtgtctggaagacccaaggaaggggcttctggtgggtcctcagagagagtgtctggcgcatcctcagtggagccttcctcctctactttctaggcacctctgggagggcaggagtgggagcagatgacaaccattttagaaggagccctctggctgggtgcggtggctcacacctgtcatcccagcactttgggaggccaaggcaggagaagcgcttgaggcctggagttcaagaccagcctgtgcaatttagctggatcccatctccaccaaaaaataccaaaattagctgggtgtggtggtgcacgcatgtagtcccacctactcaggaggctgaggaaggagagcctgtgagtttgaggctgcaatgagctttggtggcaccactgccctccagcctggatgacagagtgagatctccatctc

SEQ ID NO: 90177 - DNA, 1828 bp, Homo sapiens
tgacaaaaaagaaagacacctgttggggtggcctgccagacccaggagtggagggctctgtgagggcccgggaattcggactcaggacagggattctccatggctaggcccagaaacacagggtccaaccactctccagcagggagacctgggggtgaaggggtgagccctgcgcaggtctctgttccttggtcttcactgggcagtgtggagaggtgtggccaggaggagcccgcgtttgtccagaccagggtctactctggcaccagagtgaccacctctgacctctcctttcctcgtcctgggccgggaacgacaccaaatgagggacatggaaaggggtgagaagcataaatgtgcgtgtgtttctgcagaggagggggcatgggcccctgccgggctgcgcaggggagggtggggtgggacttttccagagagggagccaggcctggcccgggccccgggagctcacgtcacccccacccctcacttctccagggaactgccaaagccaaacccagctcgggatgggattatgtgtactgggtagacccgtggagaggggctgcgagaagagatctcggtggcagagagaagcagaggcagagagggcatgaagaggggtcggcatcagagaaggggcaggcagtgactatcaccccatttcttcttccctcagctggagtaacaagagtcaggcagagcctgaagacttgggtggaacatgggcccttctctggagatcctggcctcccccgttcagtcagggtggagttgctgaccttagtggccggcccagccaggggaaggagtggccatcggcaacccccaccccaaccccaatccctgaggcgcccgctctggctcagccactctgacccctccctcaaattccgaaccctaggtctcagggagggcagtggggctgagtgtctgcccccaggcacattcctacccttctcttggtcattttctgccccagagctggcccacctcagcaatgcgagggctccctggattcctctcccgggtgcctttcagatccaacagaaacagattttttttttcctggaaagcagaactaagagtgggatgaggagcaggggcgggaaggactcaaagtgagaagaagggggcaaagagagtcaggcttggtggctggggtggcttccaagcctcacttctccagtgttcaaagctgaacttcagatggacttcccggctcttcagaatgagaggcctgtggctggggcatgaggcagccccggctgcacctctccttcccgcttccccagctggtagagacgcacaggaaacaagccctcactgaaccaactccagatgctggcacccagagtgggtgttacattgccggcttcttctctagagattaaaccgtcaacccatttagcttatcccttggccaaaaagtgtatgagatgtgcctggatgttccctaaagagcttatctaagaagggaagagaaagccgggaggcacctctgggagggcaggagtgggagcagatgacaaccattttagaaggagccctctggctgggtgcggtggctcacacctgtcatcccagcactttgggaggccaaggcaggagaagcgcttgaggcctggagttcaagaccagcctgtgcaatttagctggatcccatctccaccaaaaaataccaaaattagctgggtgtggtggtgcacgcatgtagtcccacctactcaggaggctgaggaaggagagcctgtgagtttgaggctgcaatgagctttggtggcaccactgccctccagcctggatgacagagtgagatctccatctc

SEQ ID NO: 90178 - DNA, 431 bp, Homo sapiens
atgggaataaacaatggtgctagaacttctcagactgtgcaatattgagatgtttctctaaaggatctactcaaaattctgtcatagccttctttagaaggtaaaagttatttataacaatttgcgcaagtgaacacctatggcatctgagagatgtagacttggatctctgcaattactggatttgtcctccttgtcctccacactgcagaggagacctcaccatatactcctactgcaacaacacagaaccagtggttgcgcacctgctcagtttgtgttccgttttcactctctcctcatgatatcatcatttgcttatttcaaagctcaggctatggggttttagactttgtcacaagggaaatcagataatttttttgaaacttttttttttgagacaaagtcttgctctgttgcctggtgcagca

SEQ ID NO: 90179 - DNA, 609 bp, Homo sapiens
ccatttcaaaacgacaacagcagcaaaaacaaaagggtatagagtcatggctcacaagctactcggaagccaagtggagcagccgcacatcaggagcgggggcatggggcatggggcctgctactgcctggcaactcgtattttatctgcagccgcacttgctggtgtctttgtcctcctccagccacaggattctcctaacctagagccttgggagtctctctctgtggctcagagggactgcagggtgccttcttgtgggcatgggctcagattccaacagtaacacccatgcaagttgccagcccccttgtctgcagcctggcctccatctcccctgagggacaggagtggtgtggggctggagaggggcagtcccatacctggattcctcaccccttacagatacaggctcctgaagtcaggaaccaaataactgagtctgagatggaaattcccaggaaaatcttcaaggcaaatttacaagggatatccccccatcacccccatcgtgtgcagccctatcagagatgtccatgttatggaaagagtgacaggaatctgccctcctccccttcaccagtcagatcgtcacctgtctgactgttc

SEQ ID NO: 90180 - DNA, 783 bp, Homo sapiens
tcatcagaggtaagatttggaatcagacctttccaaaaggtcatctgaggtaaggctaagaccgcacttcctctgctgggggtgagctggcagacacaccaaacagtgccttggcagcagctcacagtgcaggaagcccaggtgatcactcttctgctgggcccaggctgcaccctgaggactcagtaactcactctcaacagaatattctgtgcaggctctccaggctctgggcgtcagggtgcaaggggcagcttgaactgtacggtccgtcctgcactcacccgatgcagaccttgactttgatgttgaaatgaacacacttgttttacccaagtctggtggaacaaatgcccaatcatgtgaccttaaagtgtactgcaaagctgtagctttaagtaattgctgttctgccactgcttactctgaaatctaccatcaaagaaagatagagaaaaggggctgagccttggaatatatggttataagcagatctttctttggtcagagaccagggtttgagccaaggctgtaaatgtgaacaatagctgtgcaaagccttttaacctgacttcttcattttgtaaattattatgcattaagtagcagcccaataatctgatttctagttttattttcaaagtaagtagcttcttttgggaaaaacctaagttaaactagtagttttgccataataactgctgatttatgtatttgctaaaggtacttttgtatctgctgtgtattatagcaataaaataatcattttgttagaaaaaaaaa

SEQ ID NO: 90181 - DNA, 293 bp, Homo sapiens
gtcagtgttagggttgctagatttagcatacacaaaaattataggctgccaagttaaattaagtttcagataagcaattagtttttttctcagtgtaagtatgttccacatgttgcatgtgacatacttatactaagtatgagatacacctaactcctcctcctatgggtagcagtgaattaagggatatagagatgcctaaaattacacactaacagaagtatcatgaaaaaatgaaggcagaggcatagggttcccatgacatactttgaggaattttgcgagtttaagtc

SEQ ID NO: 90182 - DNA, 334 bp, Homo sapiens
gtaaataagaaagtgaaataattcctataatgtaaggttgatagaagataatcatcagggtcagaattaagaggtcttgtggtttaggaagcataaaattatgtaacttattgtttatttcactcagaaaataaaagtattaatgaaaggaattagagatgaacagattgatacaaactgttctatggtttacagcttaaaaaataaaggtacatttaatgctatgcattttgagaataatgtcttttatgctttttctttttacatatatatctatttgtatttaaggacaaaatagattgacattactaattacttcactattaataattaa

SEQ ID NO: 90183 - DNA, 248 bp, Homo sapiens
cctacccgcctcctccattctcctccacacctttgcccaggactctacgctgctataaagacatcagcagcccccgtagctcacagggtgctgcttcgagccatgccagcccgctgctgatgtgacacagctagcaattactgagttcttcccacgggccagacactggttctatctacttagcacagagaggcctagtcacttgcctggggtcacatagctagaaagtagcagtccaaccttgaacc

SEQ ID NO: 90184 - DNA, 335 bp, Homo sapiens
gcacctgctggggtgaccaggtgcaccagtgtgatagggctggctctgctacaagttccccttgctaccctcccctgactgtgacctagtgacattcaaatgcaccaacggaatcccctcctgccttttcttatggctctaccctgacccccaaggaaagggtctcacccactctctgttccctgcctgcttgggggagccctagtctttggctctccgcccgtgtgacccccacctcctgttgttgtgtgcattgaatctgtctaggacagggtgtctgatcttttggcttccctgggccacacataaaacacagtaacgacagctgatcagct

SEQ ID NO: 90185 - DNA, 336 bp, Homo sapiens
attgttttactttctttttttcctcacagaacctaccccaaccaaatttcagcttccctacaccatcaccactaccaccatctaccaattttgagctatcttcactctccttttaagatacccagatgcatggttgatgctttctaaatattcacctgctgttagctcatctgttatgccatttttatataagccatccccttgccagcttttctggatgccttgaatattatttatgtctctggctttgtaaaataaaaatatacaattgaaaatgtttagaaagaccaggtgttatggccagcactttggaaggtcgaagaaggaagatcactt

SEQ ID NO: 90186 - DNA, 321 bp, Homo sapiens
ccagctttcaagaatttaaaggcttgtgttatgccagaaagtaaaactagaagcagtggtgttataataaggaacgtgatttgaatgtaacacaggaaaactgggaagagcctgagggatggaggcgcagtgtcacgttcattggcctaccagagaacttgttatgcaggagatgttcatgatgaataagtgaattcatatatatatatacacacacataaattagaattcatgcttttcatcaggaaaatatgctgccatactttcccgatgaagagtgaccatcttctcttggggatattatgaaagagattccacatt

SEQ ID NO: 90187 - DNA, 358 bp, Homo sapiens
acactctggttctaattctgttaataaaagaaatctgtatattttcatttttcaaacaactttaaaaaaataacccattaacattttgatctatatctgaatagtaggattgctggtaatattcctaatgtttttctgtacctacattattaacagtgaaattattacttttcaaaatgagcattaccaaaaaaatttttaaagacaatggtgtgtttttaaaaatatttctctattccctaaaattacctattagaggaccttgtcctcctagtagacgcttaataaatattcactgattgaatcattgtaccattgaatagggtaattaagtgtaaatagcctaagaacaaagtgt

SEQ ID NO: 90188 - DNA, 143 bp, Homo sapiens
ggtaatatcaataagattccccttggatgttctctgttacaaccagacactgaagtaaacttgctgttgaaatttaaccataatgctgcatttgtatggctgttttaactagaataaaatgttctgttgtgtagttaccaaat

SEQ ID NO: 90189 - DNA, 504 bp, Homo sapiens
  misc_feature (420)..(420): n is a, c, g, or t
  misc_feature (435)..(435): n is a, c, g, or t
  misc_feature (471)..(471): n is a, c, g, or t
ggaacgggcagaggccctggaccgccagcggaccaagaacatatccgctatcagttacatcaaccagcggaaccgggagtggaacattgtagagtctgagaaggcccttgtggtgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtggacctcttcagaagatctgtttcaaagttacacgattttggatgtggaagattggactttacaagtttccccagcttcagagttcaaagggntttagccattccacnttccaagggttcggcagcccaaggatgggggttccnaggagatttttggaatttgggagatttccaaaa

SEQ ID NO: 90190 - DNA, 244 bp, Homo sapiens
atgggttcccggctacttccctcctgtatttcttcctctcctcaagctccccaagcctgtcacaactctttcctcattctcagcaaacaacctgccaactaactgcctctgagattcccttgctcattctttcctttaaagattcagcagtccacacatcctaaaagtgacccagggcgggagtgacaagcacaaaacacagcccccaaagaatcgcccagccagccagtcaggcatagcggaa

SEQ ID NO: 90191 - DNA, 576 bp, Homo sapiens
tctaatgcacatatgagctccaatatgcacaggtatctatgtagaatcaggtactaagagtgcttcaacacaggacatgatggagagtacaaagaggtttcacttcaaatcacacactagaggaggagatacattttgattgtttgtaaaactattacatttttaagttggttctgatttcacattatggtttcaactgatgaaaggaaattatcttcttgcagattctgcttatcttttgtgatctgcaccgttctaacctacattctctgctcggtgtgttttggaacgctgttttgcacagcttcagcttgcttacttgctttgcattcctctttgaagtgaccacaaaatcctgcatcaagggtctctgccagcatcaacattttctcttctctgctctgtagtgatgatggacactttgcatgctggggctgaaggagggactgactcccttcggcaagcctgctatgtcctcttctcattcccctttcattctgccactgttctggtagtagcagtcctctttaatcctttaagattgaatggagctggtcattccaggacatagttcta

SEQ ID NO: 90192 - DNA, 280 bp, Homo sapiens
gatcgactttgagttgcttcgggtctagtagaaatccggttatttccaagcctgtgaaatgtgaagttcaagaaaattgaatccgtgtatagcaaaaccattttttctcacaattttttaaccaatgaacattgtgtgggaaattgattccatatgttttcaagtcatttatgcaacttgaataattaaaatattcattggtaagagctgcctgatgtctttaaagtcaggaaattgtcttatgccaaaagtagacaaactcaaacaccaaaaggtcaag

SEQ ID NO: 90193 - DNA, 452 bp, Homo sapiens
acctcagccgccactgccacttctctgacctcatctatttcttttgtcactttgctaaagtcacactggcctccttccttcacccagaacaccctcaaagcatgttctgtctcagagtctttgtccttgctgtctctcagtctcaaaacttcccccatatgcctacatagctgactccctcccttcaggtctctgtacaaatattcctgtactgtcagagacctgtgtcaaataacttctcatccccccactcattttctgcttcattgcctttcacagtacttatcaccatatactttgcttactggtccgtctccagtgctttgaagaatgcttggcaaatattagtcactcagtaaatatctgttggatgaaagaatgaatgaaaataataacagagctttggaattttttaaagggtaaaaaactatatgattaatttcagtttcaaa

SEQ ID NO: 90194 - DNA, 740 bp, Homo sapiens
ttgaatatcttttcacttctcaagaaaaaaatgtgctgatctaaagtggagtgggagaggttaaccttggaagtctgaaaaagagtcacctaggcaaactcttgttctcactaactccacattgtttagggaacagaaagctttagccaacaaatttcaatcagtttctctcttttctaccctactcactactatctcttttgcatttactcaatttctaagcatagatctcacttctttgaggttaccttttcacaacgaaaccgccaccaaaaaatttgtatattagtttctcctgctcttttcctatagcagcctgtacttcgtatcatagtaactatcatgctatattataatcatttgtctgtctcccctaatagatgtcaggctgttgaaagtgcttactgaatctcttttgctttatttctttgtgcctagtacacagtagtcatatttatttattaaatgactaaatgtcttgacacacaatgggtacattaggctacttgccttcataccattaggcatttaatccatttctacttctgattcagtgctcagcaaacaaacttctaattatgacttggcttcctaatcataattgattgacaaaaatgagaatgttttgatcattaaatcttctgatctgccataagacgttaatcaaccatgtgaactttgtatataaattgggaactggaaactttgaattaaacttttgcacattatcctcctgagct

SEQ ID NO: 90195 - DNA, 252 bp, Homo sapiens
gagccatgcacacacacggccgcatagtcacacacgcatatctacatgtcccccccacatatacacacacacatatacatggacccatgcacacacacagctggatattcacacacacttgcacatccactccatatacatagacacgcacagacacagctgcatgttcacacacgcggaagtgcacacggacacagacatgcatgcatatgcgcacaggtgtgtacagcctcagtggtgggggttggctgt

SEQ ID NO: 90196 - DNA, 1003 bp, Homo sapiens
  misc_feature (14)..(14): n is a, c, g, or t
  misc_feature (48)..(48): n is a, c, g, or t
ttgcagtaactgcngaattcctggttggctgatggaaagatggggcanctgttcactggtacgcagggttttagatgtatgtacctaaggatatgaggtatggcaatgaacagaaattcttttgggaatgagttttagggccattaaaggacatgacctgaagtttcctctgaggccagtccccacaactcaatataaatgtgtttcctgcatatagtcaaagttgccacttctttttcttcatatcatcgatctctgctcttaaagataatcttggttttgcctcaaactgtttgtcactacaaactttccccatgttcctaagtaaaacaggtaactgcctctcaactatatcaagtagactaaaatattgtgtctctaatatcagaaattcagctttaatatattgggtttaactctttgaaatttagagtctccttgaaatacacatgggggtgatttcctaaactttatttcttgtaaggatttatctcaggggtaacacacaaaccagcatcctgaacctctaagtatgaggacagtaagccttaagaatataaaataaactgttcttctctctgccggtggaagtgtgccctgtctattcctgaaattgcttgtttgagacgcatgagacgtgcagcacatgagacacgtgcagcagcctgtggaatattgtcagtgaagaatgtctttgcctgattagatataaagacaagttaaacacagcattagactatagatcaagcctgtgccagacacaaatgacctaatgcccagcacgggccacggaatctcctatcctcttgcttgaacagagcagcacacttctcccccaacactattagatgttctggcataattttgtagatatgtaggatttgacatggactattgttcaatgattcagaggaaatctcctttgttcagataagtacactgactactaaatggattaaaaaacacagtaataaaacccagttttccccttaaatccctagtt

SEQ ID NO: 90197 - DNA, 796 bp, Homo sapiens
tttctccctatggatgcggggtctgattctaggccagcttcgtacgcagctcagtgaccaaccacgggatggatgggatcactatcatcctaactgagtatctaggacaccattgagtttaaagactccaactcatcatcactgtaaaccatccaagtatcctgcaaaccctggcactttagcatctgaaagacacctgccagactgcctgtggcagtccctcatgcttgacttttggtgcctagggtcctgttctcctggttagagggaacttggtgtgctcacactgagggaaagtgaaggacgcggggcatcttcctgccctggccttcctgccttggtgcctgcgctccccaccatcctgcaaagaggaaccctgggagtgagtggaggtggcaggggtttggttcctgcctgctgccaggcggccttgcccagggggtgggtcccagacctgagagcaaagcgctgttctctgaagtgctttgtagctgactgcatcttgtgccttactcttttggttgattttcaaattttgtaaaagcaaatttgcatctattttctcttttacttggttatagttttaaatgtctctatgaaagggttttgaccttggatgatgtagtatatgcaataagatgctgtgattttatttcaggagcatcctgtctttgtcagtgtatagttcgtgtgtgttaaattcatgctcagacttgtaagaaacagttaaccaagccatgtgatcatagtagctcttttcagggaactactacttcaatatcattagaaagtctta

SEQ ID NO: 90198 - DNA, 273 bp, Homo sapiens
gttctacctggagtcctggggattggaccacccagcttgtcacagccactgctaacacaaatgtgtgccactggggagcctcagggttgtcccaccactgccgtggccatcatccatgctatgcatgctgcctaagagtgtgagattttgtccacactccagcctaccactgccactgctggcacctgagcaagccacgtggaaacccaagaattggcccacttggactcactaatgccaatgcactcatacactgcccaggggcccaaggat

SEQ ID NO: 90199 - DNA, 324 bp, Homo sapiens
gaccagctaagaggtctggaattatgcgggtgatgggtacaccttgaacatattgaaccagagtttggcagtttttcagagataattttgtccacagtggaaggaatggactagtggtgggaaaaattgatagcatggagagcacctagtaaactattgagtccaagagaattagaggagcccaaactaaggcaatagcaagaggagtggaaagggatggatttaaggaacaaaaacttttccataataaataatgcttaggatgaggactgttatgatgataatatcttgacatgccatgtttttaaagaattatatattatt

SEQ ID NO: 90200 - DNA, 352 bp, Homo sapiens
atcccaaccatttggaatactctaaaagcctcctgactaatctggagtcttgctgccctttaatttattcgttgcatgttagccttaatgatctttataaatgtcaatccgactgcgtcacacctttcagtggcgtccctatgggttaaaattcaaattccttaacatgaattacaaggacctgtaggatctggatcttgccaacctttccagcctgccaaattggccccgcacaataaactaaggttacttcaaaggtgccaagtgttttagccccttggaataggtacttttttactgtgactcctctggctagatgtccctcttaggttctccatagcattttgtgcat

SEQ ID NO: 90201 - DNA, 351 bp, Homo sapiens
ggcaggagatctttgatattattatcagctaaaatccagagaaggctgggaaattatagaattatttcctacatctaagggactcactggctgtgttcagagtgtcatacttatgtgccatggcgaaataaaaggaaatgatttgggaggtctgcctggaaaggcaaaacctatatgtctatgaagttgcttaggaactctcataagccactcccaacttatcaaatgcgaatttatatttgataaaaagataggaaattgttgaggggaaatactgaaagggtagtcacagttggatagtgttagactagaaagtgtcttagaaatggcataaaggaagaggagctggat

SEQ ID NO: 90202 - DNA, 526 bp, Homo sapiens
tcatctaacacccatgacaaatcacatttttaaactttcctattatatgggactttccaaaatttttatggctatttactattttgggcaaaaagacacactctttagtacctcagaaaatactctaattactttacgataagaaaacagttcactcaactacccaaagttgaaaataggtgacaatatctactctgaccgagaatttaggatttagagttttactagagtcaacttactatactgaggaaaactaattaacttaaataataataatagaactccactcaaattgaaaaatagtgaatacaaaagcaaaagtgtctaaaaattgccctgccttgaaaaatcagtgaaaacattattgatatattgattatattatttttgaatactttataaatttgatatttaaaaatttttatagatgaggtctcgctatgttgcccaggctaggtgtgaactaggctcaagagatcctcctgcttcagcctcctgagtagctgggactacaggcacatgccac

SEQ ID NO: 90203 - DNA, 361 bp, Homo sapiens
gatcttgttatgttgcccaagctggtcttgaattcatggcctcaactgatcctcccgccttggccttccaaagtgctgggattacaggtgtgagccactgtgctgggctttgtttacttagatgtttagtgtatttttgtttacctttatttaactcatcttagcactgtgtctggtactttctagataaatgtccggtaaaagaatgcataatataaataaaacataattttatatataatgggtatttcaacttcctgtttttcttcaagtgctgaaatctttttattgttctatttttttattagctccatgtattattcatggtttttgtctactgttggaatacagaattatattt

SEQ ID NO: 90204 - DNA, 136 bp, Homo sapiens
tacctatgggtaagtgcccagtttccacattgctaagattcaattagccagtaattgataaggattcactttgaccagttggtctgcctggtgcataagaataaaacatgagactagaggtgattaccaactatat

SEQ ID NO: 90205 - DNA, 324 bp, Homo sapiens
gcttcctcctcaccccacagaggtgagaaggtggctgcgacgctgttggcctgttcctcgtctgcttgcagccctctatggctcctgttccactcagggaaagcccaagtcctcactggctgccctcacagcgccctgtttccctccgcctgtgggcttttctgctgttcttccaacatgccaagctctgtcctgcctcagggcctttgcactagctgttcccccctcctgaaatgctgttcccctaggtacctgcatggctcttctgccacctgctcaggctgcccccgactctgaagtcacacgcccctcatgtcttcatgt

SEQ ID NO: 90206 - DNA, 355 bp, Homo sapiens
ttaatagttagactattttctgctatttgaaaactgaatgagattccagtatttttctacctactgaatgatttgatgacagaaatttgtattgttttaacctgttggctttcagtaacaatgctgcaataattatgtgaaagctaacatatgtgctgcattctgttttattgttctactttttcacttttatactcataccaaattgttttaattctgtagctttttgatgtgtttagaaatcagaaattgtaatgcctccaacattattccttgaagattattgagtactttattaactctttagattccatatacttttggatttgctgtttttattcaaaagtgcaatgag

SEQ ID NO: 90207 - DNA, 928 bp, Homo sapiens
tccagcttctccatccctttcctcccctcagtcgacatcctctcctctcctggagttagtcctgctgggggaccttgggcaagttccttcacctctttgagcttccgtatccttctctttaatgatctcgaatgtaacaaccccacctcatagcctcattatgagagctagatgaaatgaaacaataaccactgtttacctttcaggcacctggcagaagtgcacgctctggagctgagtggatgggtgcaaatcttggccatgctgctcctccacacccaagcggtttgggcctggactagttgcctgatgctccacacctccacatgctctcttgtcaggcagaaacagtaacagcaaccccccacgcctgttatgagagttaagtgagttgatatttctaaaacacatcagtgtggggcattaggctagcccctaatgccactcatgccaacaagtgctgtagaagagttagccattattcttaggtcagctaattatccaatcagcctgacaaaggaggtactgttattagccccattttataaacaggaaagatcagtaacttggccaagggcagaggggcaggccttgagcccagacggataagacattccagggggaggctcctcaccttcagttacactgactgctggatataagggggctccccacttggagcttaaaggtttgcaatagccaccttgaaattcttgaaaatcttaatcactttatgtttgagtttgtgttttgtaagtgaagttctgcttctgccacctccccctttccccaaatgtgcccaagactgaagagggtcagagtcaatcccataattgtgccatggggcagggctgtggaggtcttcaaggggctgtattcaccctacaagtattcctgtgcccaaaagagtatgacattaaatagcaga

SEQ ID NO: 90208 - DNA, 354 bp, Homo sapiens
agccctacttgctgcagaggggttaacagccactcaaaaagcatggagttggcctgagggcagccagaaccaggatgggttttaagcatataagtatgtggcttagacacatggggtgctgagtggagagcagatgggagagttgaagactaattaggaagtgtttgccttaatccaagcaagagacaatgaccacctggatgtggattttggcagtggagttagagatgggagtgacttcacagatatttaggactcggattattaggacttggtgggagactggatgtggggccaggggagaggttggagttgggtgcctgtgatggcctccactgcctggaactcaggccg

SEQ ID NO: 90209 - DNA, 541 bp, Homo sapiens
tttaagaatgttctctcatctgttcctaatttctaatgcctgtagtttttcttaaatggagtttaattttgtggatgttttttcagcatttcttgaaattatcatacggctttacttcctcaatttgttaatgcactgaatcatattaatagattgtaattgatgttctaatgttaggacattagaacactgctagatttggtttgctaatattttgtctcagaattttacttatttatgagtaaaattgtatttattttttatactgtgttttgtcaatttcttcctaagtttatatatctttttgctgagaattttttttgtgtcaaatttgttagcctttgtttataatattttaatctgtcttgtatatctagttatgctctttgaattctgattatctactcatttttctgtgatgttgctgagtatttgtcaattttattattccatttaaattaccaaatttgagaattgtctattgtatctttgtttttatacattcatttctgttctttattaaatcctttctgttactgtc

SEQ ID NO: 90210 - DNA, 1219 bp, Homo sapiens
gagacagtgtctcactctgtcacccaggctggagggcagtagtgcagtctcagctcattgcaacctctgcctcccaggtttaagcaattctcgtgcctcagcctcctgaatagctgggattacaggaacatgccaccactcctggctaatttttgtatttttttttaagtaaagacaaactttcaccatgttggccaggctggtcttgaactcctgacctcttacgagctaatcataccacttctaactagattttctattaatgtacaaggagggactccactactaaagtttgttttacttctctggttatttacacaaaacgctggcaatacattaaggctcactaatgtggacctaagtgagtttctgagaggctttgaatatgtatgtgcaaactgtcctattttctttatatgctctcttaaatatgtatgtctgtaaatatatatataacacacatatatatatattcctagacatctagtgtttgctgtcattagtgaccaagaaaaagtagttcttttgtgcacgcgtgaatacatcaaattagcaattaccatagaaatgtatttcattgaataaatagcttttgtttgtttgtttgtttgtttgtttcagggaaatttagaacaattattagatgttattgtgcctcttctcgtgttgatacgtgtatttgggtcaaaagtgcaaaaacttttttctacaatgtacagttattttgacttttcccaggggaagctagcaatagttttaaaagcacaaagtgatgtaaaatattttgacttttataataatgcgaagtagttttatttgcattaatcaataatgttcaggatctttttgtagtaagtatattttaaatggtgtaatttgtgtgtttatgatatgtattcaattatttaagttaagtatcagtgtatttttaaaaagtgttcccaggtgaacaaaagtttgcttttcttcaccattctgtacaggacaagcattattcagttcacatagtcagctctcactacacttcaacagaacggggcaagttcgtatttgaattctgttatatttatctaagggaagcaaaattaaccttttaataatagattatctttaatggttattaaaagaatgttattgaccaaaaagacatattttgagattaataaagatgtattagattatccaaaaaaagtggatgtgtgcaaatgtggtcctaatc

SEQ ID NO: 90211 - DNA, 877 bp, Homo sapiens
cacgcctttgcagtgcctttggcctctactgctgcaccctgtactcttcccttcgccctctgtgactcccctcaagcccctcctccgtgtcctaccttccctgggacagtgccttgcctaccttgttcctggctctcttcattggtgacctgtggttatgacaaaaaagttgaggatgtgggagtaggggagagaagagtggagggcggaaagcagaagaagaaagtgaaagaagctctagaggaaaccacagggcctgtggggaaggagggtcattgccgtggtaacccctggttgtgggggaagggtataggtcctggctatcccatagcctgaggccagccaagcccacccagagaaagagcccctcctctccaattgtcccctcctagcagctacacctctgcaatccatctgacatttattgagcacctactataagatgggcacttggctaggtgtggtggctccagcagggaagccttgtagagccagtccctgcctacaaggagtgctccttctggtaggggagatcgacctgtgaacacagacctcatgtctagttccctctcaaagctcttagtgatctgtatgggccaggagcaaatcccattaatattttcctgctctccctacgggcttcatccttgccttggcttcagctgttgttcctgcactctctgcttctcccagttcacctcctccacccctttcccaggatccactactgtgttggctcctggttccccaatcacatgctctgagcctggccctatgcctctctcttccaagtttccagttgtgtggaccttgaatttctcaaagcctcttcacttctcacctctgctacttctcatccctactaattctcttatca

SEQ ID NO: 90212 - DNA, 762 bp, Homo sapiens
atacattcctcctctaggttgtgattcatttgttcaacagataatgggagttctttacctcacggaacttacagtttagcaggagagataagatatgccgggtttaatacaatgtgaaatgtgataagtactctaaatagagctgtgtggatttagatcctggaggccattgagatcatgtccacaaggtgggttgagacagttggggtattctggtctgtgtattttatcatgaaaagcatcctgtataacacattattaaaatattttcttatatttgcataagaaacattggaaagatacagaagatactgtcaggatggggcaggacagaccagttcagggatggacttgataccgctcagtctatgcctctctactcccaccaaccccagttttttaatttttatttgggaaaactcgaaacctacaggaatactggaagaaggacagtaaacacccatatatcctttatctagattcactaatggttaatattgtagccacatttgctttatctctttctatttatatatactttttaaatcttttgagattaagttgcagacatcatgacatttcgtccctgtgtacttcagcttgtatttcccaggaacaaggacattctcctccataaccacaataacattaccacacccaggatgtttaacattgatataattctgttatctaatacatagtccgtattcgaatgacagttgtctttttagggtttaaattttgtaccatgattaataaaaa

SEQ ID NO: 90213 - DNA, 132 bp, Homo sapiens
tctaggagtgtcttttacatttctttatattgttagtaaatccttgtgaaaatctctatggataaatggggttattaccacctttattaaaattaccatagtaagcaagtttgtgttgaatttagccatatg

SEQ ID NO: 90214 - DNA, 388 bp, Homo sapiens
agctgacacgcttcaggcctttggttagcttcgctgactgtccctacagcgggagggcaggtggcaccgccaagagcctgcccacctcggaagctgactccttgtgccaccaggcaggcaggacggcctaggttgggggatcagggtggccaacaggctgtttcctgtcctgcaaccactggtaccaacctcccaggcttggtgggaagaagccagggctggaaggtgtcttggtaaccgctggaggctttggcacaggggacacgggctggggctggacctgggttccaaccctgtctccttcctgagcagctacaggctccagcgaatttcctgtgcctctcccatcccagagtcttccgaagacctctgggaggaaaagcaccct

SEQ ID NO: 90215 - DNA, 652 bp, Homo sapiens
tctcaaaaacaaacacacaaaaaattaaataagagttttgcagtctttgctgtcaaatttctttctcagtgacatagtgaaacggatccttatcaagtacacaggtaaaacaaaagacttcatgctaaggtctgaagcacaagcattaatgttaagtgctcatagctgctagtggcaactgtgagtgaaatgaagcaattttttttttttttgagacggagtttcactcttgtcacccaggctgagatcgtgctactacagtccagcctgggtgacagagcgagactctgtccccctcactagaaaaataaataaaataaaaataacaaaaatgtggaaagtagagaataatttattgaaatggttaatctatttttaaaaacagacaactgaaggcctgccccaatgtaaaaacttagtatgcataaaacaaaaactaaaaacaaaaatttcaaaacatctgaatgttgaaagaaaaaccattacaaacaaattcaaaagacaaaactggtaagttcacattaagtaggataaaacattaaaaaattttaagctataaagaattgttcatactctaacaaaaccagaaaagaaaaagaaaaaaatttccactaagaaccacaaagataaaagggcaaagacaagaaacaaa

SEQ ID NO: 90216 - DNA, 315 bp, Homo sapiens
ttttttttgtaagggactgctgataatgaattttgtttgttgtctctctacaatgtctttatctccctgttactcttgatatgtatttttgcttgctatagaattgttagcagcaacttttagcactttgaatgtattttttcatgtcatttcattttaaaagttggctgtcagtcttttgttatttttctctttggtttttatccatcttactgtgatgtggttgggtagcttttgttttaccctacagtttagaggaaaaatcgttgaaataatttgaggctaagggagatgatatcttccagactggattta

SEQ ID NO: 90217 - DNA, 366 bp, Homo sapiens
ggactctgcaatagtctgtatggtccatgaggcaaaggactgggtttacctggaaagcctccgctatgcccataactagcataatgtctgacatttaggcgatattcaagaaatatttgttgaatgaatgaaatacttgataaataacttcaacctttttaactgataaatttttaaatgattaattttaaaccaacataaccttctaaattaatattcctttccctcctcatcatcctctaaaaggacacatgaactctctattctgctggtttaagcagatgatctagacatcaacctagatgcatcatttaatttaatttaaggtaaaccagcaattccattttttgttgccgacaatgaatt

SEQ ID NO: 90218 - DNA, 497 bp, Homo sapiens
gagatgaagttttgctcttgttgcccagactggagtgcagtggtgtgacctctgctcattgcaacctccgcctcctgggttcaagcaattctcctacctcagcctcctgagtagctggaattacaggcacctgacaccacacctggctaattttttgtatttttagtagagatggggttttgccatgttggccatgttggtctcttaactcctgacctcaagtgagccacccgcttctgcctcccaaagtgctgggattacaggagtgagccaccgtgtcccactgtgagtgagtgagccacggcaaaagtctttaaagacagcatgtttcagaggctgtgacggtgccctgtgaacacgccaaatctcgcagtcccgggagctctgaggagcaggcccagctccttgccaggctgatggtactgaaactctgctctccaagacataacctgatggccgtgcaagatttcttaattgactgtggaccgtgagagtct

SEQ ID NO: 90219 - DNA, 403 bp, Homo sapiens
ttgggattacaggcacgcgccacaatgcacagctaacttctgtatctagacggggtttcaccatgttggccaggctggtcttgaactcctcacctcaggtgatccacctgcctcggcctcccaaagtgctgggattacagatgtgaggcaccgagcctggctttgcttttttttttttttttgagatagtgtcttgctttatcgcccaggctggagtgcagtggcaatctcagctcactgcgacctccgcctcccaggttcaagcaattcttctgcctcaggcttctgagtagctgggattacaggcgtgtgccactgtacccggctactttttgtatttttagtagagaccgggtttcaccatattggccaggctggtatcgaactcctgacctcacgtgat

SEQ ID NO: 90220 - DNA, 444 bp, Homo sapiens
cccctagggtcaaagcacaaagagaaataaacttcagcacctgaaaattctgtaataagagtctttgaaaatggaaaaaaaatctatgcttgaccattgttgtctaagagaagtttgctatcaatccctcctctaacgccctgaacagaatgttcttcaccagaaccctgtgtattcatcaccacacaggctgagaggcattccagcatttgtgcaacatcaagatttatgtgcaattatctttatggcaaatgttccacaagttatagctgttaaaagaaaataagatgcaaatgaacaagaagaagcagaggcgctgcctgcagcctgggaaaatttgggaagctagcctaatgagtgaatttgttttaaaaggaaagttggcaaaccttattccagttcattaaatttcaacaaacagcaaggattaaagtaagaatcaac

SEQ ID NO: 90221 - DNA, 491 bp, Homo sapiens
aatggattggtttttcttcggaatctttgaagcctttaaacagttccttgtgctgctttaaaattaggccaaagcatggtaagtcgtaacttaatctccattcttcttaccacgaaagggcagacatttcactagcgtggtagtgtgttattacctcctctcactgccaaaccattcagattgttcttcttcctggatggtggttaaaacctcagctgtgtcctcctgttgggctgttttcccaggtcctgttcctctttgcactctagccagttcttcacctcttgtctcagtagcccaggctctctgtgctgtgatccccattacctcctgctgccccccactcctatactctctgcatttatggatctccctgggctctccaggcttttgctcttattgcccgtctgctggagccattccccctctccagtggctaccaaggtaaagttcttccttctcacggcaatgagcacaaatagagccttttg

SEQ ID NO: 90222 - DNA, 331 bp, Homo sapiens
ccaagttgaggtcaatctccttctcctttctgctgtcttgttgagaacatccagaattttatgcattttctggcttcaaagagaagcacacctattaatattcactgctggttatcttgaaagttggaaaaccaagacttcccagctgcaggagacgacattagataaacataaacatgactttccacaggagggactgtcccaatgcagagcagatttactcgactttaagcatgctgatggtaaatgttctcccccaaggtcaagagcaatggtggtttattatttaattttattagtagacaaaaatgggcagttaaggactgtattt

SEQ ID NO: 90223 - DNA, 364 bp, Homo sapiens
cctcccaggttcatcccattctcctgcctcagcctcccgagtagcctggactacaggcacccgccgccacgcctggctaagttttttgtatttttagtagagtcagggtttcaccgtgttagccaggatggtctcgatctcctgacctcgtgatctgcctgccttggcctcccaaagtgctgggattacaggcgtgagccaccgcgcccggccgagagtgatttttcttagaacacaatgccaagacattgaaaacagtctcccttctcagtcccttctttaaaatgccctcatgtcaaaatttggatttgattcctactctgtttccttcctctataaccactcaagaggagtggggatctca

SEQ ID NO: 90224 - DNA, 242 bp, Homo sapiens
tgttgccatgtgaagaaggacatgtttgctactccttccaccatgattgtaagtttcccgagacctccccagccatgctgaactgtgagtcaataaagcctctttcctttataaattacagagtctcagttatgtctttatttgcaagatgagaatggactaatacactggtgataaatttgatggaactaaaattttattttgagcatgttacattttctcctttctgctcttgtcctcca

SEQ ID NO: 90225 - DNA, 332 bp, Homo sapiens
tgagtcctggggagtgatcataaacaaacatattcttgcttccatgcccttggttcctgggcccaaatattctatttactgaagacacagcatcatttaagggctactgatttaggcagattatggtgtcttaaggaatagcactccatctttgcagggtatcacctcccaattagcacctcagctgtcccttcataaagctgttctgtcatgcctacaactcctggatgtcttagtatataataagaccaggaggtccatggccatgtacccaccaccatgtctcctttttctataaagtgggtgaatggtttgaatcagatattatttag

SEQ ID NO: 90226 - DNA, 233 bp, Homo sapiens
gatatcctctagaggccacaaattcattcggtaaattgactcaagaccctccatagactctaagaatagttcataatttttttatttatttggcacacatgtgtttaacatctacagcttcctggtttagaaagaatctttttgtaaaaatagtatcctacataggacagggaaataacaggaatctgagattctggttgcaattcagagtatttctttttctttgctttttt

SEQ ID NO: 90227 - DNA, 232 bp, Homo sapiens
aagtgctatattcattgtattatagagaaggttggggagcacagaagaggatcaacccagctttagaaggattagagaaagcttccagaggggtggacatttgagctagcaagaaagcacaagggaaaaggcatttagacagaggagacaatttgtcctgacccagaagcattggggtatgctatgcatggatagacaaagaatttgtgcaaaaggggagcagcaaggcatg

SEQ ID NO: 90228 - DNA, 268 bp, Homo sapiens
tcataaattttgtgctcaagtctgactcagttaatatgcccagtttgctttcataaatgtgggggtagttaccagttacccttgtaatttatttattgtgtttcctcattagaacccttgggtgcaaaacagtgagataaaagcttcatattcaaacagatttgactggaaaaatcaaataatttgactattagaaaaccatatatggttagcattccatgtggaatggtcagaaagtgagagaatgagatgaccccagccattggtg

SEQ ID NO: 90229 - DNA, 2062 bp, Homo sapiens
tgaggatatagttttttctatttgaggtttaaatatctttccatcccaaagtctgagttattcaaggtctggctcattctgttgacaagacctacatacatgtggatccagtcaaacttgcatggctgaacaaactactaaagtaatataattaagtaattgctatatactcttgtggatgaggggtaggatggaaaggctcagattccttctggttgaattaaaatctctatcagcatgtggttagattgacattgctagaaagggagcctgaaactaaacatacattaaacgaagaaggtattttgtaattcccttggctgaagatccagtgtctaagctagaatctttgcagagcacagaatcctgtgtgttcgtgggatgtacctaccccactgcaaattgagcctaattgagcaaaccactccgatggtttcaccttcccctgtcatagtgatgcagtgaacaaagctatttcagtgagaatgaaagggaaatttggcaaggaatatcagcttgcactatttaagtcttggaatgtcattcaagatgttcttgttctgtttctagtgtaatgtttaagcccacagaatcagaccggaatatataacgtcatgttagaattaagataaatacacttgtcatacttaagaagccacatttcaataagatatgctaccactggctaaaagccacagattttttttttcctgtatccatacgatcaactgtcagttggccccagcaatggaaaagaacagaatagaggataatccaataaagtgaaatcatttgggacctcttatgtaattttatcttgtagtagagcttccatcttaatttgctttgcttacgctaatttcatgtgaatttatattctcgggcatcatgctagaatgtaaataaccctgttcccagaattaagagatccaggcaaccaagcagtctataccactagcctttggcaaatggcttaaatttcccggcctgtttgtccattcttgaatacagataagaacatatgctttcctactttataaactcttagcacgttccacattatgtgagctgagtgactcagagctgagctggattactggccaaagttagcctgggaagataaagagatgtttgaggtacctcacacaaaattaataagctgatgtggtcatagatatgtttccagttgaggccctcacatgaacccttaactgaattaaataaaactgggactagaaaatgttgacattttctgcacttccccaacaaaaaaaaaagaaaagaaaagaaaagaaaaaaataaataaaatgttgacatttctagaaatacagccaaacaaggctgtactgattctacaccaaagcacaacaccgcattgcttgggccactgacctgaaactgggaaggagttctcttctgaaaaattgatatttaaaatcattatgaggaaataggattccataaacattttcctgatgaacaaaaatggtcgtctctatgtttaaaacaccacacacacatataccaaaactgcatactcacttattcatgtgaaaatcactgcttctttgtaaaatattacgtaacatctaccatgatattctacagaaatgctgtacttgaggttatctggtttgctggagagatattaacttagcaaaaattacttttataaaattgaaaggaaaaagaccaatacatcaacttaaattgcaggagtttatgtagctgctttctctgtagtttaaaaagcaatgcataaatgcatactcactatccttggaacttaataccagctcatctatagagcaccttcttaaagacgatgtactgatgtaaggttttgtaaatttctaaactgttttaaacgggatattatcttttgcaataaacttacatattttttctaggttttaagactccattactagcttgggttgatttcagttataaaatgtatgcttaagaaggacacctcaatggtcctaagggcaagtatggctttcattataattgcttctatatatttctaagggaaataaataaagagcagattcagaa

SEQ ID NO: 90230 - DNA, 1159 bp, Homo sapiens
  misc_feature (14)..(14): n is a, c, g, or t
  misc_feature (26)..(26): n is a, c, g, or t
  misc_feature (39)..(39): n is a, c, g, or t
  misc_feature (60)..(60): n is a, c, g, or t
  misc_feature (64)..(64): n is a, c, g, or t
  misc_feature (78)..(78): n is a, c, g, or t
  misc_feature (87)..(87): n is a, c, g, or t
  misc_feature (108)..(109): n is a, c, g, or t
  misc_feature (111)..(111): n is a, c, g, or t
  misc_feature (131)..(131): n is a, c, g, or t
cagatgagagtttnacaaatgtattnccagtggtctgcngattttcctctacatacagcntttnaaaaacacattaancacagaccngtttccagactagactaatgnngnaattacaattcagtgcgagnatattttagactgcatttcattctattatgtgagctgagtgactcagagctgagctggattactggccaaagttagcctgggaagataaagagatgtttgaggtacctcacacaaaattaataagctgatgtggtcatagatatgtttccagttgaggccctcacatgaacccttaactgaattaaataaaactgggactagaaaatgttgacattttctgcacttccccaacaaaaaaaaaagaaaagaaaagaaaagaaaaaaataaataaaatgttgacatttctagaaatacagccaaacaaggctgtactgattctacaccaaagcacaacaccgcattgcttgggccactgacctgaaactgggaaggagttctcttctgaaaaattgatatttaaaatcattatgaggaaataggattccataaacattttcctgatgaacaaaaatggtcgtctctatgtttaaaacaccacacacacatataccaaaactgcatactcacttattcatgtgaaaatcactgcttctttgtaaaatattacgtaacatctaccatgatattctacagaaatgctgtacttgaggttatctggtttgctggagagatattaacttagcaaaaattacttttataaaattgaaaggaaaaagaccaatacatcaacttaaattgcaggagtttatgtagctgctttctctgtagtttaaaaagcaatgcataaatgcatactcactatccttggaacttaataccagctcatctatagagcaccttcttaaagacgatgtactgatgtaaggttttgtaaatttctaaactgttttaaacgggatattatcttttgcaataaacttacatattttttctaggttttaagactccattactagcttgggttgatttcagttataaaatgtatgcttaagaaggacacctcaatggtcctaagggcaagtatggctttcattataattgcttctatatatttctaagggaaataaataaagagcagattcagaa

SEQ ID NO: 90231 - DNA, 206 bp, Homo sapiens
ccaaatgaggcaacataactgctgaaatgagtactgagaattcttaatttacatatattaaaaatctgccccaaggccaggcacggtggctcaggcccataatcccagcattttcggaggctgaggcgggcaggtcacttgaggccaagagtttgagatcagcctggccaacatggtgaaattccacctctactaaaaatacaaaa

SEQ ID NO: 90232 - DNA, 261 bp, Homo sapiens
ttattttctaatgcacgttgatttctcaaatgtcttctttttatttgggaggaaagtggagcaaaatattggaataggattctctagtgaccattctcctataagaacatgggaaatggataattttttcctcccataggaaatggataatttgaacaattatccatgcattaaatacctttacaagagctaagaaaaccaggtgagtgatcacagtacctggttttaagataacgataagaaaagacacattgaagaagg

SEQ ID NO: 90233 - DNA, 677 bp, Homo sapiens
cacagttttgccaaggattttgctacttaccacaaggatggcatttacttcaatttccgataccttgttcctcatttccccctgagccttcaccagaattgcccttaatgctctgttttcaggagtctaggcttttgctagtctgctcctcccagttctttcaacctctatccattagccgcttcccattaaccaaagctgcttctacatttgcaggtattatagcaacagcctcactcttggtaccattttttctttcaatgtctttcctgctgacatagagaaatatcacagactgggcaatttataaagacaagaggtttatttggcttacagatctggagactgggaagtccaagatcaagggtccataactgatgagggcctcctgctgttatccaaggcagaaggaaggggaagcaagcacccaagacagagaaaacagctgatttcatcctttttatcagaagaccgttcccaagacataattcacccctccaataagggcattgatctctttctgagggcagatccctcatgacctagtcataactgtcccacctcccaataccattacactgacaaatttcaacatgagcttttgtggggacacgcaagcatagcacacgtgtctacactatgagtatttccactcttaaatctatatcaaaaaaaaa

SEQ ID NO: 90234 - DNA, 467 bp, Homo sapiens
cctcctgggttcaatccattctcctgcctcagcctcccaagtagctgggattacaggcacatgcctccataccgggctaatttttgtatttttagtagagatggggtttcgccatgtgggccaggctgttctcgaatgcctgacctcaggtgatccacccgccttggcctcccaaagtgctggaattacaggtgtgagccactgtgcccagctgagtaaatttcttgattgcacagaatgtacggtgatattggcggacttaaggacatcgaattgtttatcaggaataaagtattatgtgtgttttctgcggccctggataatgctgtagcattcagggtcgattgagtaaaaaaaatgtagagatggtttcctgtttgtttttgcttctagttttcattcatttgctatttattctcttctggctttgcttgtgtatgcatatatataaaaccattattattatt

SEQ ID NO: 90235 - DNA, 415 bp, Homo sapiens
tggagctgcgcttgtggtggagctggaccctgaaattacctggaccttttttttagagacagggtttctttctgcagtctcaaactcctagccttgattgatcctcctgccttggcctcccaaagtgctggaattacaggtgtgagccactgtgcccagctgagtaaatttcttgattgcacagaatgtacggtgatattggcggacttaaggacatcgaattgtttatcaggaataaagtattatgtgtgttttctgcggccctggataatgctgtagcattcagggtcgattgagtaaaaaaaatgtagagatggtttcctgtttgtttttgcttctagttttcattcatttgctatttattctcttctggctttgcttgtgtatgcatatatataaaaccattattattatt

SEQ ID NO: 90236 - DNA, 310 bp, Homo sapiens
gcccaccgtcgggtttttgctgtttccttcccgaataactctcccttgggctgggccttatcccagaaagcacagactggcacgcagcaagccaatgagaatgagccagtctgtgatgtcatgagttaccaggcacaagggactcctggagcgtcctaaaccatccttgctggttgctggagtaggcagggtgcagcctcatccttgcagttcccaatgggtctgttttagtccgttttgtgccgctttaacagaataccacagactgcgtaatatacaaacaaacaaacaaacaaacaaaaaacaccca

SEQ ID NO: 90237 - DNA, 452 bp, Homo sapiens
  misc_feature (394)..(394): n is a, c, g, or t
  misc_feature (397)..(397): n is a, c, g, or t
gctccgtccgtctatcttctgaatctacttttcaggtgtaaatttattttttcttctaaaagtatgtttttatcctctaatttccctatcttctctattcttttcttcgccttcccgtacttctgtcttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggactttcgtaacggaagtaattcaagatcaagagtaattaccaacttaatgtttttgcattggactttgagttaagattattttttaaatcctgaggactagcattaattgacagctgacccanggntacacagaagtggattcagtgaatctaggaagacagcgcagacaggattccaggg

SEQ ID NO: 90238 - DNA, 1153 bp, Homo sapiens
  misc_feature (90)..(90): n is a, c, g, or t
  misc_feature (93)..(94): n is a, c, g, or t
  misc_feature (99)..(100): n is a, c, g, or t
  misc_feature (116)..(116): n is a, c, g, or t
  misc_feature (127)..(127): n is a, c, g, or t
  misc_feature (170)..(170): n is a, c, g, or t
tggctggtgcagaagtagaaggtaaagctgagaagatgagggtgttacgtagaccagaaccaagtttagaagaatacttcaagctagaanggnnagttnnttaaaaatcacatcanaaagctactanaaggactggtgtaatttaaaaaaaactaaggcagaaggctttnggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttatttttttaacacgaattggaggaaaaccaaatgaattggatagccaattggagacaatttcagcaaatctggtaagcagttggtatgttcagtgggggtaatgaagtattcagtttggtgaatagatgaccggttttaacttcctcaccctgaattcgttggtaaatgtagagttggatgtgtaa

SEQ ID NO: 90239 - DNA, 966 bp, Homo sapiens
  misc_feature (90)..(90): n is a, c, g, or t
  misc_feature (93)..(94): n is a, c, g, or t
  misc_feature (99)..(100): n is a, c, g, or t
  misc_feature (116)..(116): n is a, c, g, or t
  misc_feature (127)..(127): n is a, c, g, or t
  misc_feature (170)..(170): n is a, c, g, or t
tggctggtgcagaagtagaaggtaaagctgagaagatgagggtgttacgtagaccagaaccaagtttagaagaatacttcaagctagaanggnnagttnnttaaaaatcacatcanaaagctactanaaggactggtgtaatttaaaaaaaactaaggcagaaggctttnggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagccaagcccaggctcgcagtatcaataaagcagttctctgagaa

SEQ ID NO: 90240 - DNA, 1100 bp, Homo sapiens
  misc_feature (74)..(74): n is a, c, g, or t
  misc_feature (117)..(117): n is a, c, g, or t
tgatctagaggtatccccttatgtatctgacccacaggcaatcttgcttacgagtcacatatatagtctactanaaggactggtgtaatttaaaaaaaactaaggcagaaggctttnggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttatttttttaacacgaattggaggaaaaccaaatgaattggatagccaattggagacaatttcagcaaatctggtaagcagttggtatgttcagtgggggtaatgaagtattcagtttggtgaatagatgaccggttttaacttcctcaccctgaattcgttggtaaatgtagagttggatgtgtaa

SEQ ID NO: 90241 - DNA, 1070 bp, Homo sapiens
  misc_feature (44)..(44): n is a, c, g, or t
  misc_feature (87)..(87): n is a, c, g, or t
ggtgacctgaggatcccggcagaatcacactcaaaagctactanaaggactggtgtaatttaaaaaaaactaaggcagaaggctttnggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttatttttttaacacgaattggaggaaaaccaaatgaattggatagccaattggagacaatttcagcaaatctggtaagcagttggtatgttcagtgggggtaatgaagtattcagtttggtgaatagatgaccggttttaacttcctcaccctgaattcgttggtaaatgtagagttggatgtgtaa

SEQ ID NO: 90242 - DNA, 1159 bp, Homo sapiens
  misc_feature (133)..(133): n is a, c, g, or t
  misc_feature (176)..(176): n is a, c, g, or t
cagaagattagaacggtaacgcttgtccacgctgagaggtgtatactgtcctactcacaaccaggctttcgcaaggactacttgaagctagagatgggaacgtgggttaaacctcacgtcaacaagctactanaaggactggtgtaatttaaaaaaaactaaggcagaaggctttnggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttatttttttaacacgaattggaggaaaaccaaatgaattggatagccaattggagacaatttcagcaaatctggtaagcagttggtatgttcagtgggggtaatgaagtattcagtttggtgaatagatgaccggttttaacttcctcaccctgaattcgttggtaaatgtagagttggatgtgtaa

SEQ ID NO: 90243 - DNA, 994 bp, Homo sapiens
caacggatacggcagaatacactcaaagtcaatgtaaaaacattaagttggtaattactcttgatcttgaattactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttatttttttaacacgaattggaggaaaaccaaatgaattggatagccaattggagacaatttcagcaaatctggtaagcagttggtatgttcagtgggggtaatgaagtattcagtttggtgaatagatgaccggttttaacttcctcaccctgaattcgttggtaaatgtagagttggatgtgtaa

SEQ ID NO: 90244 - DNA, 705 bp, Homo sapiens
  misc_feature (74)..(74): n is a, c, g, or t
  misc_feature (117)..(117): n is a, c, g, or t
  misc_feature (647)..(647): n is a, c, g, or t
  misc_feature (650)..(650): n is a, c, g, or t
tgatctagaggtatccccttatgtatctgacccacaggcaatcttgcttacgagtcacatatatagtctactanaaggactggtgtaatttaaaaaaaactaaggcagaaggctttnggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccanggntacacagaagtggattcagtgaatctaggaagacagcgcagacaggattccaggg

SEQ ID NO: 90245 - DNA, 813 bp, Homo sapiens
attagaatgcattgtgaaacgactggagtatgattaaaagttgtgttccccaatgcttggagtagtgattgttgaaggaaaaaatccagctgagtgataaaggcttagtgttgaggaaatttctgcagttttaagtagtcgtatttgtgattgaagctgagtacattttgctggtgtatttttaggtaaaatgctttttgttcatttctggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttatttttttaacacgaattggaggaaaaccaaatgaattggatagccaattggagacaatttcagcaaatctggtaagcagttggtatgttcagtgggggtaatgaagtattcagtttggtgaatagatgaccggttttaacttcctcaccctgaattcgttggtaaatgtagagttggatgtgtaa

SEQ ID NO: 90246 - DNA, 645 bp, Homo sapiens
  misc_feature (133)..(133): n is a, c, g, or t
  misc_feature (176)..(176): n is a, c, g, or t
cagaagattagaacggtaacgcttgtccacgctgagaggtgtatactgtcctactcacaaccaggctttcgcaaggactacttgaagctagagatgggaacgtgggttaaacctcacgtcaacaagctactanaaggactggtgtaatttaaaaaaaactaaggcagaaggctttnggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatct

SEQ ID NO: 90247 - DNA, 243 bp, Homo sapiens
tcagttcattgctgttgagcagtgggttctcaaactttattgtgcattgcaatgacctggagcacatggtaaaacacgaaatcccatgtctcacccccaaagtttctgattcagcagctctagagtggagcctaaaaatctgcatttctggccaggtgaggttgctcagccctgtaatcccaggactttgggaggctgagtggggaggattgcttgaggccaggagttagagaccagcctggg

SEQ ID NO: 90248 - DNA, 430 bp, Homo sapiens
ggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaaaaagggggtctggttgcgtcgcccgggccgttttttttctttggtacaaagggggttcaac

SEQ ID NO: 90249 - DNA, 377 bp, Homo sapiens
ttatgtaccagacgttttggaaatgttcaactgaatgagatttggaagtatacatatttttctatgatatatgcactcaagttaaaaatgtctttgtacaggagattcgaaaaatatgagcctctagtctagagacttaggaagagtgatggtgtaactgctgacctacaagcatcacacagaggcatcatcactttggcattggtttataaactcaccgacaagataatcttttcctcctccaaactcccatggcacctctagcataaagtgcactgcacttcaacactgttgttcatctgtcacatccattacactgtgagctccttgacatcagggtaggcaacctattcatcttttagaacccagcagagctg

SEQ ID NO: 90250 - DNA, 342 bp, Homo sapiens
atgcctgacttcagctgatccaccggccttggcctcccgaaatgctgggattgcaggcatgagttgccgtgcccagccacaaattttcttttaccttggaaaacatatatgcaaatatacttgtcaactatccgacaaaggtcttcagtatgtatgtatggattcattgaactttgtttctttttacataatgaatattttatgatttttagctttggttttttgaaatgaaccaataaattgaagagacacaagaagtaatatgtgtgtaaataccagcacgcttagcccctcaaataaacctcttacaggtgtctgactcctaaatccaatttgatattt

SEQ ID NO: 90251 - DNA, 480 bp, Homo sapiens
cctagccccatttatttcagaggatgtcctttccccaatgtgtgctcttagcatgttcatcaatcagctggctgtaaatacatggatttctgggttctctattctgtaccactgtcctatgtgtctgtttttatgtgtgtaccatgctgttttggttactattggttaatattctttgggatattttgaggagaattgacattattactattttaaatgttcaacaggaaaagcatcagggtttgggctgttctttgatggactaattcttattactgattcaattttgtgactcattattgctgtactcaggtgttctattccattatgatttggtcttggtaggctgtatgacctttgaccttcctgtgcctggatatttatatttttcttgaggtttggaaatgctttgtagtataatttgaagtcaggtagtgtgatgcctccagctttgttctttttcccaatgttgctttggct

SEQ ID NO: 90252 - DNA, 442 bp, Homo sapiens
aaaatagctcaatgtttgcatggaagctacgcatgttctcctgtatactttaagtcatgtctagattacttaccatatctcatgcaatgtaaatgctgtgcaaataattgttattttgtattgtttagggaataatgacaaggaaaaacgtctgtacatgttcagtacagacccaaccacccatttttttcccgaaatatttttgttccgaggttggttgaatccacagatgtagaaccacggataggaaggctgactgtacttatttctttgtgatttgcttctttctaaaagtgaagtgctaaaaaggttccacttgactgagcctcagcggatcgtggcactgttgcacgtgtgtctaaatggtgtttggtacctttgttttccttaacctgatgaacaaggacactgactctcatggctgatggggagctaaagttat

SEQ ID NO: 90253 - DNA, 594 bp, Homo sapiens
ttttctttttcagttgttgcaaagctgccctgccctcttcacatcttctccctctgtgtatttattgaagagaaccgcttggtttcaggaagctgggcgcgggatatccgaagtgtggaggaaacagacaagtcagggtacagaggtgggggttgggcaggggcgcagggctgaccccctcacccggtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaa

SEQ ID NO: 90254 - DNA, 490 bp, Homo sapiens
aaaggggctcgaccccaatcttgctatcagcaactcccgagacctggggagaggcttccgaggggatagggaaactgtctccggggtgggccagtcctgggtctggatgctggggttccctggcacgctggggcagggtggggacctgggctctgccccacgtgtccctggtttacttggtttactttacctctgtgggtcttaattgtctcctctgtaaaacggtgattgtaattcccatttggaagaattgtcatgaggacctgtaaatgggggctggggagagaggacgtcctggaagtctgagggaagtgggacgcggcagcagggccaggagagaaattcttctcccccttcctcctcttcctcctcccagaggctccgccaggcagaggcacgtggtcctggcacccccttgtggccggtcctcagggcttccccaggaggtgctggacatggcataggctcctccaagaccccctcagtggtg

SEQ ID NO: 90255 - DNA, 903 bp, Homo sapiens
ctccttccaacgtcttcctaatacggctcattcctcgcttctcatctctgcaccttagtatcttttttctttttatttatttttaagacagggtctcactgtattgcctcagctggtcgctaactcctgggctcaagtaatcctcctgccttggcctcccaaagtgctgggattacaggcatgagccatggtgcctggcctgctcaatgtcttgagggtattgttccatcatcttccagtatctgatgctgctgctgagaagtctgatgctaattccattctcatttccttgtatttaagaagacttttctctctggaagctctcaacaatttcatctttgtttctggagtttttgttggtggtggtgttgttttgatttttgagataggtctcactctgtggcccgggctggagtgcaatggtgccatcatggctcactgcagccttgacctcctgggcccaaccaatcttcccacctcagcctcttgagtagctgggaccacagatgcatgccaccatgcccagctaatttatttttagtttttgtagagaccatgtcttcatatgttggccaggctggtctcgaactcctggactcaagtgaccctccaacctcggtctcccaaagtgctgggattacaggcatgagccactgcttgttttcagagttttgagattcatcaagatatgtctgagtggggtattttctccattcccactattcagcattaggtggtcttttaaatctacaaggttgtgctttttttcagctcaggaaaaatttccccacatgcctgcacacataccttacatctttgactttgtgtttgggaactggagaattgtcttctacttaaccttccagataacctgcttggcctttcattcagaatattctaatg

SEQ ID NO: 90256 - DNA, 3340 bp, Homo sapiens
ctctaaagctttagagcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaggcggagacgtctacgtggagagggtccagggcaactcagtcttgttgcacatctcaaaactccagatgaaggatgctggcgagtatgagtgtcacacaccaaacactgatgagaattactatggaagttacagagcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccagctttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcgtgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaagtgatgttaaccaacacctttgacctgtcctgtgtcgtgagggccggttactctgacctcaaggtgccactcactgtgacgtggcagttccagccagctagctctcacatcttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagggcaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcacg

SEQ ID NO: 90257 - DNA, 967 bp, Homo sapiens
taaaggacagcttctcttccactcaatattgccattgttcccaagaaacatgtttaaaaaaaaaattataagacatggactagtcctcattagcatgtttgcatagcaaccagtcaagagcatttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaaggtgggggctttttaattgggctaaccagggtgtgaatgaatcctggttctgtcctcaactatgtctgcggccttgggcaagttacctaggaatcagagggagcattcactgagtgcttattggttctacgcactgttaggtgttcctttgtgtcttacctcatccacctctcgcatccccccttggaacaagatagcatcattaccctacatctcttgaaggttcaggtccctgggctgcaaggagataagaggctccctcacacagcctctggagggctaaatgagatcctacagcaatgccctggtggggcttctctctccctcttatgtcacttgtcacacctgctctaggtaatcattttcctccagatgagaggtgtaggaaaggacctgatgccagcaaggaaaaaggaattggtaacatgctctttgtttacctaaaatctgtccccacaacaagaatgtaacttccttcgaggcagaaattcaattttcttctcccagcccacctacaaaggcccactcaagagcaagttctgtgtaaaggtgcttaactaatacaggttctttgacaaaatgataaaacatttgtaacctgaaaaaaa

SEQ ID NO: 90258 - DNA, 752 bp, Homo sapiens
gtatcttttgcccatgtggttgcagtcaatccaatttaattcagatcagcaaaagttactgagcacatgtgctaggcactgtaggggatatagaaacaaatggcactatcagacatactcaagtaactatagtgaacaaaggagacgagtaaaagggaattaaagaggcctaaacaaagggctgagtgagaacgggatggaagagaagaactgtgcctgcagcaagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagcttcctgccttgctgcctgtttcttcccaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcacg

SEQ ID NO: 90259 - DNA, 643 bp, Homo sapiens
agtgtaaaatatttaatatatatatttaattcagtatacaatattttattttttaatttaaaaagcatacattactatatgtgtcatacatttgtgcatacatcttgcttactaagagtgcattcagaaaaccatgtgtactgtcctttctgggtgatttaaggaagagtcatgagcgttttttactctaaggattttgttttttttgggtttacctaccgctatagaattgaactcccacataaaatgtgatccctgtgacatccttacagagggtgtcatctctctctggtactgaaaggacagaggctgtgggctctctaaatacctgccttgcttttgtttcccagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccagctttcaaagttaggccccaaggctttctctctcaagatcttctctctgggcccagaggatgaaggcgcctacagatgtgtg

SEQ ID NO: 90260 - DNA, 3727 bp, Homo sapiens
ctctaaagctttagagcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaggcggagacgtctacgtggagagggtccagggcaactcagtcttgttgcacatctcaaaactccagatgaaggatgctggcgagtatgagtgtcacacaccaaacactgatgagaattactatggaagttacagagcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccagctttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcgtgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaagtgatgttaaccaacacctttgacctgtcctgtgtcgtgagggccggttactctgacctcaaggtgccactcactgtgacgtggcagttccagccagctagctctcacatcttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagggcaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaaggtgggggctttttaattgggctaaccagggtgtgaatgaatcctggttctgtcctcaactatgtctgcggccttgggcaagttacctaggaatcagagggagcattcactgagtgcttattggttctacgcactgttaggtgttcctttgtgtcttacctcatccacctctcgcatccccccttggaacaagatagcatcattaccctacatctcttgaaggttcaggtccctgggctgcaaggagataagaggctccctcacacagcctctggagggctaaatgagatcctacagcaatgccctggtggggcttctctctccctcttatgtcacttgtcacacctgctctaggtaatcattttcctccagatgagaggtgtaggaaaggacctgatgccagcaaggaaaaaggaattggtaacatgctctttgtttacctaaaatctgtccccacaacaagaatgtaacttccttcgaggcagaaattcaattttcttctcccagcccacctacaaaggcccactcaagagcaagttctgtgtaaaggtgcttaactaatacaggttctttgacaaaatgataaaacatttgtaacctgaaaaaaa

SEQ ID NO: 90261 - DNA, 756 bp, Homo sapiens
ctggtttaactgaatagtcctagtttatttttatttctcaatacaattattaatagtgcagactctccccctacaaaaacatgttccactttgaataatgaattacacattaccttacctgattggctattatctcctttatggaacattagctaagctttggctgtaaagtggacaaaattagaattagtgctgcgattttcctgtaagagtacaggaaaggtggtcaaactggttaaatcaccctgccttttcctttacagaaaaatcacaaacctggcaatataaacaaaatgaggatggcttttaacaatggaagaaccatccctgttcccctgtcttcgttagaatttgctatttgtaggccaggcgcagtagttcccacctgtaatcccagcatttcggaaggccgaggcgggcagatcacaaggtcaggagttcaagaccagcctggcgaatatggtgaaacccggcctctactaaaaatacaaaaattagccagacatggtgctgcatgcctgtagtcccagctactcaggaggctgaggtgggagtatcgcttgaacctgggaggcggaggttgcagtgaactgagattgcactactgcagtccagcctgggtgacagagcaagactctgtctcaaaaaaaaaattgctattcatgcagcttgtcaggaccatttcagaataatgagaactctcttgccagcccctagggattttaaatgtcatgaatagttatgagaaaaagtctc

SEQ ID NO: 90262 - DNA, 301 bp, Homo sapiens
ggggaaagctaattggcaataatccttgcgggaaggtcagactcctctcttacagatctagggaaggcctggggtaaaatgatggctctttggaaaatgccaagctccttcagattccataccctctcgggccctctagcataggcaacgaacttgttcctggcttcacgctttctcattgaatcaaagctctcaagcatggcctggatttgtaaacacatgctggctgccagcagtggcaagttagcctcctgacccacttctctcctgctttcactctggtgtatgaagggggatgagg

SEQ ID NO: 90263 - DNA, 696 bp, Homo sapiens
caaaacaattcaaaatgttgctttattgccccacaaacaagcattttcaaacaatgttatagcatatgtatactgtcaatatcttaaaaattaatgtatttataaatatatcggaaaaatatggttatgcaataatgtacttttaagaaatggtatatcagaccaagattacctgatgatgcatcagaaggcttgatagcttttatatttagtaacagaaaaattgtttcattttatcatttatttttcgtcaaagtttttataagcatatatgaattaagtattcattagttcattgatatgaccattgaccatttttaaaagtctaaattgtaatatgttaactcctgatggcttgctgtcaataaattatttttttcctatgatcagtttactttgggaaacactgccatagtcaaagggatatctccaacccaaagttcaaactaaatacttccattgtgtaagatgccacattttgaagcacagagaaatatctggcagctttgtagtttgaagccaattcaaacgggtgctatgtttcagttgcactgatgtgttactatttttttaggtgaaagaaggcaacaggtagattcccctgcctgacacaatgataaccgcacttttcacattttcgtgtttattctaaacaagattactgagagtcatataaagctttacctttacccaaag

SEQ ID NO: 90264 - DNA, 1072 bp, Homo sapiens
ccactttaatcttcctggtgagcatgtcagcaacacccaaacatcactaacatggattattgcatgtatatttacacataagataagaagtgtttattctcataatagtctttgtcatcattcttgaggttaagttcaattctgctttatgtggcttgttggattgtcccagtccttgtatttaacaacatttgcagaaaatagtaccacattaaatcaattatagattatcccttatccaaaatgcttaagaccagaatgtttgagatttaagaaatttttcaggttttggaatgtctgcatatatataatgagatatcttggggatgggacccaagtctaaacacaaaattcatttatgtttcataaatgaaacttaatgcacatagcctgaaggaaattttatttttcccttagggatgttgaatcaactgttgtgtgccagcatgttgacaatgacctgtcacatgaagtcgggtgtggaattttccacttgtgcgttcatggcggtgctcagaaagtttgggattttgaagcattttatatttcagattttcacattagaaatactcaagctgtccttgctcacagtggccaaaaaaaaagagaaaagaaaagaaatactcaaccagtagtccagtagtagttatcactagaaatgaatgaaaatctattgcagtattattgagtttttcctaattattccagtgcagataaaaagaaaagaataaaaaggaagagaataaaaacagagaggcaactctgatattttagtaaattctatttatagaaggtcttgagtatttcttctgcttcctcccttactttaaggatgaacattgttaagacaactgcttcatttctctatactgtttttctaagtttctggaagtggttgactactgcagggccagaatgggccagagaaatgacttgacacttgaaggccacttccttcccttttgagttcccaatgaagctgtcacatacaaggctcttggcttcagagttgctctcctgagtttttgattctcacccctactctctaacacatcaaataggaaagaaagaa

SEQ ID NO: 90265 - DNA, 464 bp, Homo sapiens
attggacccagaagttccgggtacagagtctgggtgagctcactttgcctctgcagcagctgcaaacatatgacaagtgcttcggtctcacctggtttctaggtaacctcaggagacaggtgtttacctcattccccgagcagcaaaagtcacacaatggcagggcctggttctcacgcatctcatcacacatcctgtccacgctgcctccttggagcctaggctggggagccgccttagggatgtacccacctatgcttctggcattgggctcaaggtctgaggtggggttttactttgttctgtaacctgcaaagttgataggagaccccattgctctgttgggtgggtttagcgtggccccaaactgggcctctgctgcctggtcactgagtatctccctgtggtgccccctcactaccttctgcactaacatcaccacgtctcgtctgagccaaattctg

SEQ ID NO: 90266 - DNA, 552 bp, Homo sapiens
cttgagccagaagttcaagaccagcctggccaacatgatgaaaccccttctctacgaaaaatacaaaaattagctgggtgtggtggtgtgcgcctgtaatcctagcctcttgggaggctgaggcacgagaatcgcttgaacccaggaggtgaaggttgaagggagccaagatcacaccactgtactccagcctgggtgacagagcaagactctatctcagacaaaacaaaacaaaacaaaaagcactgccagtattcattttgaggttacaaataaatttcagtgaggaggcaaatttacaaatatggaatcatgagtaataaggattgactgcatatttcttggcactgactgtatgccaagcactgcactaggcattcaccctggccctgtctgaacttagttaatagtcacgttcacctgccttttttgtttgtttgtttttgtatttttagtagagacggggtttctcaccattttggccacgctgatctccaactcctgacctcaggcaatccacccacttcggcctcccaaagtgctgggattata

SEQ ID NO: 90267 - DNA, 326 bp, Homo sapiens
cctgccccgggtgcgtctcttcactcccactaaggaggaaacggctcagagaggggaagtgtttggccaaggtcacccagcgagtaagtgggaaccgagattccaaaccccgtcccagagatgccaaggcctcctgagagacagagaagcagacagcaactgagaggcagagagatggtgacagacacaaagagacaaaagagagagacagagacggaacagagcacaactttatctcaggcctgagaccagagtttgtgctgagagtcctcggcatgacgactcataccctggggcaggacacgaagcggggcagggggcgatgc

SEQ ID NO: 90268 - DNA, 717 bp, Homo sapiens
gagaaggaagagaacaggttggagttgggatggaagaatgatttctctgaatgtaccttagaatctaattttggctttggaaacattcatgttttacatgttgaaaaaataaaattaaatcaaaagaaaaattgacagcagatacatttcacacaagtgtttttcttacttagtacccttttattctgaggaaagaatttgaggcagcttaaatcagagcacagatatatactgtatgcactttgataaattttgatttttctataactgctagagaataaaaccatttggagagactcttgccagggcaactgtgtaatctggtggcactgtgtattggtaactactaactcactccttcctctgaaaagtgacctaaaaaacaagagtaagttttgggatagattctgcttctgcccctcagaaatgacaccaccacgagctgactttcaggattcttgaagtaatgtagtttatacaggtaagcatttgatgatttgctgcttatatttggctcataatgatgcaacataaaaggtgagcatatatgtaattcatcctggctctgcaaaccgcaggtctggcaaggcttaataaggagagtggaatgaagagctgcaactaagactaaactaaaactactttttttttttttttccctctttcttcaacttctgattgttttgtttaaatgaccagaataagatagaatgcctg

SEQ ID NO: 90269 - DNA, 172 bp, Homo sapiens
aaaaacaaaacaaaacaaaacaaaacaaaacaaaaaaaggctactctggctgctctgtgggggttggattattgggaagaaagttagcaagtacctgcagtgaccaagcaagagatgacggcttggactgagccattggtcatgatgatggagttggttaggaggtaagatc

SEQ ID NO: 90270 - DNA, 400 bp, Homo sapiens
cagcctcccatgtagctgggagtataggcatatgccaccaaacccagctgatttttgtatattttgtagacaccgaggtcttattttgttgcccaggctgatattgaactcctgagtttaagcaatctgcctgcctcagcctcccaatgttactggcatgagccaccgtgctgggccatgagttgacttctaagtgagagtttgttattctcacaaatcttattgtctatagaataaagttcagaccccctactagaccctgaggcagaaagcttaataagacagtattgctgccctagttaccactctctgtcacctcgggattgcagatgtgtaaacatcattttcatataaatgtggtggcccacagtgatatatacagaatgatagtattacatat

SEQ ID NO: 90271 - DNA, 306 bp, Homo sapiens
cccccaagcttccagatgagaactgtctggttgacacaccgagtccagccttgtgacaccctaaacagagaaccagccacaccctgctgttctgatctacaggaccatgagccagtacatgggtattgttttagccggctaaacttgtggtattagttagggagcaacagaaagctaatacaggccaggcgcagtggctcacacctgtaatcccagcactttgggaggccgaggcgggtagatcacctaaggtcaggagttcgagaccagcactcctgtgttttgtattttcgtaaaaatacaaaa

SEQ ID NO: 90272 - DNA, 2985 bp, Homo sapiens
  misc_feature (1126)..(1126): n is a, c, g, or t
  misc_feature (1150)..(1150): n is a, c, g, or t
ctttattctgaaaaaagttaacatttcttgagatctcattgaaaatattttcctagttagaaatttatgatgtattcatatttgtcttaaagtgcttaaatattacctacagttgcaaattccatttattctttagcacagtagatgctactgatgcctttacttcattatcagaacagagcacaggagagaagaattacaactctctgacttagtaggcaccattagactgcttaataatagctggagattctgatacataattttaaaggcttaatgtaaatgttattcaaccaaatatattttacaagctattttctttgaacatgtatacattttagttgtagaagtcagttgtctcttaaacaaagtatcttcataggaaaaatcattattttgtgaactctgaaatgaatgaaaattttaaatacaatatcagggtagcctgtaaatgatactggaaataaactgacccaaacacacttaaccagcctgttttccgtttagctgtttccatactttttttttctcttttaaaacttggcaagttgcattttgaatcttcataaattatggtagcttaaaaaatatataaaatatggaatggtgtaaagctaatgttctggaagaatcattgcttttgaaatggcaaatcaacaattctaaaattagggtaaatatctagggtagatatgtagatgtggaattgctgtgtcaaaggataggtgaatgtttaactatataagaaactgtcaaaatttttcaaaagtggttgcgctattttatcctccttttcagtttcttaatggtggtttttggatggacagctttttctcttttttttttttttgagatggagtctggctctgtcacccaggctggagggcagtggcgcgatctcggttcactgcaagctccacctcccaggttcacgccattctcctgccttagcttcccaagtagctgggactacaggcacctgccaccacgcccagctaattttttgtgtttttagtagtgacagggtttcaccatgttagccaggatggtcagaagcttttaatgtttataaagctttgtttattttttttcttttatggttactgccttatctctttgatctaanagatctttgcttaccccaaagtcnggaaaatattctacattgtcttttagaggcatcatagttttagtttttacattaaatctgtcattaatctcaaattaatttttggcatggtgtgagtttggttccaagatttccttttttttttttttttaacatcttgatagccatttgtgccagcgccactggtgtttcctttttccattaatccagttttgtatcttcataaaaagtcaattaactttctatgtattggtctatttctggactctgttctatcgattttctgtttttcttttggcatatttatcttgattgttataatttcatgaagtcttgagatcaggtagtgtgtgtcctccaactttgtacttactattagtttattgatttcttcagtgaagcctgttggattttctcggagaattgtattgagtccagagcatttgggggagaatcaacatcttaatattgggcctcaatatttcataattttcaatgtagcagtcttgcatgcgtgtttaaaaatttattcttaagtattttataattttacactactatcagtagaacttttgaacttgattttccagttgtttgttgtcagtatgtagatatacaattgatttttgtatagtgactttgtagtctgataagtctgtttcacttattacttctagtggtttgtttatatagaaaactaagaaatttgcaattatgtttcctgtgactatcgttttacttctttctttctaatccttatgtcttgtcttgctttttattggtttattatactgtccaggacttccatagtgttgaacagaagtcacgagaatgggcataattgcattgtttccaagcttaggcagaaagctttcagtagtccaccatatggtatgatgtctgtatgatctgcagagaaaacctttatcaaaatgaggacattccttttaaactttgtttcttggcagtttttatcataacgatgtttaatgctgtcaaatgtctctttctgtatctgttgagatgattatacaaatttcttcattctgccaatgaattacattggtttcattttcaacttttaaactaactttacatccctgagataaaccccacttggttgtggtgtgttgtcctttgggatattgctagatttgatttctaggtgtttttttttcttttcttttttttttttttttaagatttctatattggtgttgatgggagatattggactttgtatccttttcttgtaatgtctttatttgattttggtgtcaaggttttattgggtgtcataaaattagatgggaagtgctgtctccttccctgtttttggaaatagctgtgtaagatcggtatgatttcttctttacatgtttgataggatttaccagtgaaatcatctgaacctagagggttttatttggtttggttttagttttttgtgggagaattaagattttttaagagatattttcagatttttctgttgtcagttttggtaatttgtgtcttttaggaaaatttcatttcatccaagttgttggatttattggcataaaatttttcagaatattcctttaatatccttttactgtctgtagaatctaatctgtattgcagtctcttcatattggtaatttgtgttttttctgttttttcctggatcagtcagtctagctggaggtttatcaattctttataagatcacttattttagatcattaatgatcttttagtacaggggtattcaatcttttagcttccctgggccacaatggaaggagaagaattgttttgggccacacatagaatacactaacgataagctgatgagtcaaaaaaaaaaaaaa

SEQ ID NO: 90273 - DNA, 438 bp, Homo sapiens
gatttcactatgttggccaggctggtctcgaaccctccacctcaagtgatctgccctcctcagcctcccaaagtgcgggagtcaccgtgcccagccagactgttttgttgataagtcctttagtatgtaactctactaggtaagggcatttaaaaaaaattaataccaaaaccatcatcacacctacaaccaattaactctttaatggcatcagatgtccagtttttgttcccatattcctgactgtaaatgttttttaaagtttgaatcagcatccagcaaggtccacacattttgttgtcttttcagtgtctttttctgattgttgaatttttctttctttctttttttttttttttttcctttttgagacagggtcttgctctgtcaccagactggagtccagtggtgcaatcatagctcactgcagtctgaact

SEQ ID NO: 90274 - DNA, 567 bp, Homo sapiens
acgtgtttgaaactgaagtgccaagtacgctgcggtgagtggagaaagatggatctctaaagcatggtgtcttccttcctgccggcaggctccgtggacattcgtggctgcagaagggtcttggctttgcaggggtggacggagagcggccaaggagcggccaggaggctcgagcaggtcctggtctttcccggacaggccgtgcgggagtcaccgtgcccagccagactgttttgttgataagtcctttagtatgtaactctactaggtaagggcatttaaaaaaaattaataccaaaaccatcatcacacctacaaccaattaactctttaatggcatcagatgtccagtttttgttcccatattcctgactgtaaatgttttttaaagtttgaatcagcatccagcaaggtccacacattttgttgtcttttcagtgtctttttctgattgttgaatttttctttctttctttttttttttttttttcctttttgagacagggtcttgctctgtcaccagactggagtccagtggtgcaatcatagctcactgcagtctgaact

SEQ ID NO: 90275 - DNA, 366 bp, Homo sapiens
agtcaaaaatgcactttcaacttccaatatttcaattaattatggctttatcgaaacaaaacctcatcctaagtctaggagcatctgtacaaaacggggagaccatgctcccccaaggaaggacaaaggtttgtagctctctgctcagggcagaaggtgtggcaagtcaggcttttggtccagcctccagccaaggcagaggacagagctaccactcccctgacatgcctaactctggattcttatgtgggccaaagggaacataaaataagttctccttaacttagagagggctaactaatagctggtgtctttctcttgaactacaagccaatctctttttaagaatgttatgaacctagaggg

SEQ ID NO: 90276 - DNA, 343 bp, Homo sapiens
ctgctcaggtaggagggaggcagaggggctccctggcagcgggcgtaatagtcattcactggggaagctggtaacactagacattctaggccttacccacgtgaataagctgtttagtaagaaagaacagaattgtttcttattaggtttgctggaattgctgcatactggctcacataaaggagccactttcccactggaaagaaagatagtagggatcaaaagaaaaggtggtggtctatgaaaataaggggggaaatgggaaagcaggagtaatttcaggttttaaatttatattatttctccaggggtatgtgtagggtaagggggtcagaaggaatgg

SEQ ID NO: 90277 - DNA, 540 bp, Homo sapiens
gctcatcacacacatatacccggtcttgtgcgtctgccagctcggctgtgtctggggcaggctgtccctgagcttagcatgcagtgagttctcacatgtgcatgtgtggtgtgctcccgtttccagcttatgtgagtagataggccctaatgtgaaatggatacagtagggccacactgtctttttgatggcacatttaaacagtttggctctgcacttacagactcatctgctgctctgcgtctggcagcttacagtttaacaatgaagagcaggccaggcctctaatcccagcactttgggaggccaaggtgggcagatcacgaggtcaggagatcgaaaccatcctggccggcacagtgaaaccccatctctactaaaaatacaaaaattagctggacctggtggtgcgtgcctttaatcccagctactcgggaggctgaggcaggagaattgcttgaaccagggagtcggaggttgcagtgagccgagatctcgccactgcactgcagcctgatggcagagtgagactctgtctta

SEQ ID NO: 90278 - DNA, 366 bp, Homo sapiens
ggattatcgggagctatttctcttttccggacttccttatcttctaattattttgtctagggcctgtaataatttctcagtgattttgagtacctttgaaaacagaataagggatggagtttagttaagtctatttaatctttgcagaggaaaaaatgcttatgatttgtaaattaaataggaaaaacaaggccgggtgcagtggctcgctcctggagggctgaggccagagaattgcttgagcctaggacggggaggttgcagtgagccgagattgtgccactgcactccagcctggacgacacagtgagaacttgtctcaaaaaaaaggaaaaacaaaaatggttgggagggttatagatacat

SEQ ID NO: 90279 - DNA, 333 bp, Homo sapiens
aaccagtgcaaagtagagcagcaaaatcagcctccttgttaggaacactcagcttctaaccatgtggcccacgatgctgtacctcccagaacctagaccactgtctggcactgggtagacactcaagaagtatttgtttaatatacatgaatgatattttgaaagtgtaagttcatttttgttttacctttttgtagtagcagttagtgattgttgttgccaatagtcaggaggaactttgggatttcatatctgacgtgactctgcaggctgggctattggctacctgtagcaaagtctactaattgtctcccagtatccattctatggatc

SEQ ID NO: 90280 - DNA, 1157 bp, Homo sapiens
tctcagccccctgagtagctgggactacaggtgcccgccaccacacctgactaatttttgtatgttttgtagagacagggtttcaccatgttggccaggtgcccattattatttgatctggaattaactgagctactgcaggaattgcttgattcactgatgactggtgttgagccagtacacacccacacccaaggactgtgactgtcttctgaggtccatcctcagaaattcctgtctcttcacctagtgtgtaataaggcctgcgcgtgttatatggaactgtaaaaaatgcgccaaccatctgtccttcctctttatctgattacttatcattgttctctaagttgcaagttaatagactgatcataaattaatgcatgctggagacttgctgtttcctactagcagcatataaaagttatttttaaagttgttttaaatctgtgagtaaaaataaattgctttgctgcaagaaacaccaaacatggaaaagctaacggttcaaagttaataatttatcttatggacatcactagtggcatagttgctttaaacagtgagaggatttaatagatatttgatttgcaagtgggatgaagggtggtctaacctttgtcctgtgtttaccttccatgagatcctagaggttgtacagcacagtagtggcatgtgacacacttgagagtgcctgttctgtttggaaacctggaaactatgaagggaagtggccttcgagcttaacacataagacttgggaggccaaaccttttattctctttaaatattcactttaggataagcatttttttaggtgttaggaacagggaaaactgtgtggttaggaaggaagaaagaagaaagttaactgttgtacattccctaggtaatgtttttaagcattgttattcactttcaaaacacattttatttatttggacttaatattttgatcttattttttcaatttcttttaatttaacagacaggatgagtttttttatagttgtattacttagaaattatactaaaaatggccgagtgtggtggctcacacctgtaatcccagcactttgggaggccaaggcaggtggatcacttggatcacttgaggttgggagttcaagaccagcctggccaacatagcaaaaccccgt

SEQ ID NO: 90281 - DNA, 291 bp, Homo sapiens
gcagttttggggaactatttcaagacctggtcacgtttatcttttttttttaaaagcaccattactgccccctctccctactcctcctggttctttactatcccaaggttgatttctcatatctttcatcagacttctgaatgttcctaacactgtaatcaccctattcagttctttccttcatcttttacttttggctgcctatctttggtaattgataactttatacatcgtatctttttacagcaaaagttctttttagctttataagcctagaaggcagggaactgt

SEQ ID NO: 90282 - DNA, 1008 bp, Homo sapiens
tgagtcaattttccagacatctttaattagcaatatgtttaagtagttacaagcctttccttcttttcttgtgacagtttgggttgaatttctatcgtttgcagcctgtcactgtaaggcacaaacatgatcacgcaagatgcgatagtagatttaagccagttgtttttaagtttgtgtttaaggagaaactaacaatgaaaacggcctcgttgacggaggaaaagttggaatgcagcctctggtgctgtttgagcgatccctctccccggggcctggccgcgcgctgctgtgttctggaagggctcattgtacagtcaaggcggcaggaatcctcttcatctttctcaccaatatgttttgtggactctgacgagccaaatctgacatcagttctggaacatctagaagatactaagaacaaccattcagtgaagagagaagccaagctattttctcttttcctcatgaacattatatttagaaattaaatgttaagagataatatgatataatgttaagagataatatgatataaaagcatgattaatgactataatcttagaggaattaaagtctgggtattttaagtccttcaaatcttatttactacctggtttctctttattatttcccacatgtataaccttagtttagattaggaattcaagatctccttttcctgaatgctaaccattaagccaagcaagcattttgggtagagatgactagccaaggtgggaggtagaaaaaagaccaaggtggaactgaagggagagatgggtagagtcacaccagaactagtgcgagggaattgccttttctttcaagggtctgtaagtctgcagtaaaagtcaaaggtatttaaatagaaagttttgtttttgtttttagtatataaagaagtataactttccatgttgcaaaaattttaaaaacctttattataaaactcataagcaaccataagcttataaaactcataagcaatcaatagtaaaatataga

SEQ ID NO: 90283 - DNA, 588 bp, Homo sapiens
tgagtcaattttccagacatctttaattagcaatatgtttaagtagttacaagcctttccttcttttcttgtgacagtttgggttgaatttctatcgtttgcagcctgtcactgtaaggcacaaacatgatcacgcaagatgcgatagtagatttaagccagttgtttttaagtttgtgtttaaggagaaactaacaatgaaaacggcctcgttgacggaggaaaagttggaatgcagcctctggtgctgtttgagcgatccctctccccggggcctggccgcgcgctgctgtgttctggaagggctcattgtacagtcaaggcggcaggaatcctcttcatctttctcaccaatatgttttgtggactctgacgagccaaatctgacatcagttctggaacatctagaagatactaagaacaaccattcagtgaagagagaagccaagctattttctcttttcctcatgaacattatatttagaaattaaatgttaagagataatatgatataatgttaagagataatatgatataaaagcatgattaatgactataatcttagaggaattaaagtctgggtatttt

SEQ ID NO: 90284 - DNA, 868 bp, Homo sapiens
ggcccctcttggccgccgtcgccacgcaccgagtttgtgtttaaggagaaactaacaatgaaaacggcctcgttgacggaggaaaagttggaatgcagcctctggtgctgtttgagcgatccctctccccggggcctggccgcgcgctgctgtgttctggaagggctcattgtacagtcaaggcggcaggaatcctcttcatctttctcaccaatatgttttgtggactctgacgagccaaatctgacatcagttctggaacatctagaagatactaagaacaaccattcagtgaagagagaagccaagctattttctcttttcctcatgaacattatatttagaaattaaatgttaagagataatatgatataatgttaagagataatatgatataaaagcatgattaatgactataatcttagaggaattaaagtctgggtattttaagtccttcaaatcttatttactacctggtttctctttattatttcccacatgtataaccttagtttagattaggaattcaagatctccttttcctgaatgctaaccattaagccaagcaagcattttgggtagagatgactagccaaggtgggaggtagaaaaaagaccaaggtggaactgaagggagagatgggtagagtcacaccagaactagtgcgagggaattgccttttctttcaagggtctgtaagtctgcagtaaaagtcaaaggtatttaaatagaaagttttgtttttgtttttagtatataaagaagtataactttccatgttgcaaaaattttaaaaacctttattataaaactcataagcaaccataagcttataaaactcataagcaatcaatagtaaaatataga

SEQ ID NO: 90285 - DNA, 1032 bp, Homo sapiens
  misc_feature (190)..(190): n is a, c, g, or t
  misc_feature (193)..(193): n is a, c, g, or t
  misc_feature (201)..(201): n is a, c, g, or t
  misc_feature (213)..(213): n is a, c, g, or t
tcgttcgttagcgcgcggtcgatgctcccaggcccactaggggtggcccaaggcggctggctgcggccgtctacctcccggtatgtcgttcgatcttcagctgtgcgttaccacgccgccgtgagtcacggcatggagtcaggatagcacaatccaccagttcccgctgatcacgctgagcgtgcggaanggnaaggccgngcccccgccgcncaccggaggtcacgtccaccatccccaccgcgcaccccaccccacccccgccatgcaacgggattgaagggtcctgccggtgggaccctgtccggcccagtgccactgccccccgaggctgctagacgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaaaaaaaagaaaaagaaaagaaaag

SEQ ID NO: 90286 - DNA, 268 bp, Homo sapiens
tgtgagagggccatgttagggactgaaggtcactggtgtggctggcatgtgctgtgtgcacacatggttgtgagtgtgtgtgcatgcatgtgtatctacgtgtgtgtttgagcatgtggtgggtacaagggtgtgggtgtgaacatatggtgtgtgcaaacatggagggcgtgtgtatgcacccctgtgtgctaatgtatgtgtatgtgagtgtgagagcatgttgtgtgggtgtgtgcatgcacccctgtgtatgtgcctgtgtagg

SEQ ID NO: 90287 - DNA, 213 bp, Homo sapiens
ggctctgtactggcagaagcaggtatgctagctgggaactattgctatgaaaggtgttgtgtagacattacttcacccagagatatgtgcagtcttagtgcctccccagtaatgatggtgaaacccaagctcatacaagtccttacaaaaggctctttttagaagctgacaaatcctagagaaggtgttatgctcctgcctcaaaaaatgatc

SEQ ID NO: 90288 - DNA, 336 bp, Homo sapiens
ggcttcctaaagtgctgggattacagacatgagctactttcccaggctacaaaaaacaaccatttttaactgagcacttactatgtctgaggcactgtactagtgcaccccatccattactgtgtttaaacatcacaacagtggtgtttaaagagaatggggcccagagaggttaagtgacttgcctaaggtcacacagcaaagaagtcgaattggtattcaaacctaggttagaacagcatttgtctttttttaatgagaaattttaaacattcagacaaatggagagagcagtacaacgaaactacaagtaccgattaccagaatagcataatg

SEQ ID NO: 90289 - DNA, 481 bp, Homo sapiens
gtatcccacttgtatctgcattttttccctttcggatgtcttttgtttatattcaattaagttgtgtaaggtgaattcgatgctttgtttggttttacctaagtacttggtttgatttattcatctggctggtggtatgttttcctgggagttcctattcactgatcctaagtctcaaacgtctattataactgctaactaacagccccatcttgccacccgtggcaataaacaaagaacaggcacagtccagggagggcctaacaagtccctgtggtccttttcaccaacagagatgagccagatatagaagggagcaaaataaaaaataattcttaagagtaagaaagtgaacaagggagataatgaagaaggaaaatgaaagagagggaagaaaaaaggacgataacaaggaaacctgtgaactgttcactgttgtccacaggtttccttgttaccattctgatgttggagcggccgc

SEQ ID NO: 90290 - DNA, 1565 bp, Homo sapiens
cctgagcataaaaatttgggtaggactgtgagcgagagagaatagaaaagggtacaaacaaactattgaggcaatggatatgtttattatcatgactttggtgattgtttttatatattttacactttaacaatgtgcaactgaatgtcactaatacctcaataaagctgttagaaaagaaaaattccaaataaaatctggatttctcaatcctcttttataacctctggcaaagctgtgttgattccatcattagcctctcctcatgtcttacgtgggtcaactctgattttatagtatcaaaaactggaagcaatgttgttggaaattcagaatctcggggaagaagaactggagacaaggaaggttatgtccacctgagtcaccaggaattatgtttaggtttaaaaaaaaaaagacttatctcagaagtatagaatctcccttcattcagtcatgaggctcctacctgtgcagtagtggtttgaattaacaggctttatgtctgtgtctgtcttccactactatagcaaaacaccacagattgcgtaatttataaagtagtttgtttcatacagttctggaggctgggaagtccaagggtatggcactggtatctgcttggcatctggtgagggccttgttactctgtcataatatgacagaagggcaagtgagcatgaaagacagagacagctgattttataaaaacgtcactctcgggttaacaaacccactcttatgataaaggcattgattcctttataagggcagagccatcatgacctaatcacctcttaaaggtcccatttctccacactgttaaaatggcaattaaaattcaacatacgttttataacgccagagacacaagaatccataacacctttggattacttgctctgacaatgactttgcctacaggagatacacacgtctgtaggtcctcagagtttctgtataccctcatctcacatagccatagttactgaaacattcatggatgtctctttacaaggcgctcatccattccactctagtttgctggtgtctcatacttcatattaatacaatcactgtttctgtacagactatggttcccaaactgcttgctatggtttgaccatctcctccaaaagtcacattgaagcttaatctacagtgtggtagtactgagaggtgcgacctttaagaggtgattgaatcatgagggctctatcctcaggaatgaattaatcaatttatgggttgatagactaatgggttatcctgggagaactggtggttttataagaagagaaagggccaggggccgtggctcttgcctgtaatcccagcactttggggggccaaggcgggcagatcacctgaggtcaggagttcgagaccagcctgatcaacatgggagaaaccctgctctactaaaaataaaaacttagcggggtgtggtggcacatgcctgtaatcccagctactcaagaggctgagacagaagaattgcttgaacccgggaggcagaggttgcggtgagccaacccaggaagcggaggtgcagtgagccaaga

SEQ ID NO: 90291 - DNA, 503 bp, Homo sapiens
tcaagaatgaaacacattgccctgctagtagtttggtcaacacagcattcaaaaattcagttcagcaaacatttgaaattaatgcaatatttgttcacttcattagcaaatgtacaagtccttgcgagtacaagatcttgtgctaggtgttgagggttcagtattgataaaacactgtctactcttactggaattacaattttaggcaagcaccccaaattatgccataatgaaatcaatggataggaaggcggtgggagggctttaggaacacagttcagaaggagctattaatttttccgggtagaaccaggagtgttttaagaagagctgaaatttgcacaaggtctttggtaaaattttgccaggtgtggtggcatgcaactgtaatcccagctactcgggagtctgaggcaagagaatcacttgaacctgggaggcagaggttgcaatgagccaagatcacaccactgcactccagcctggagacagagccagactcc

SEQ ID NO: 90292 - DNA, 502 bp, Homo sapiens
ctctcatcctgattctttgtgaccaaaaatatggtttagcaagatgactagctacagagaaaacctcacctatgcatgcgagagcagacccaggacgtcagcttttctgcactactcaagtaaacaagacatagagaaatatttgaggacagcaggccagtgtggataccaatgggtgcatctcaaagctgtagctacaagagaaaattgaatgatctccacatcatcccaacgcacacttttgggtcaggattttccccaaacgctttctccactgcaccaccctgactcacagtaagaacttcttttgacaccgtggtctaaaagactgaggctgtgaccatgagaaaattacttaatctctctcagcagatttcctcataagcaaaatgagcatgtaatacctacctcttagggatgttatgaaaagaaaatcaatctaagcgcctataacaaggcctagcacagggtaaatgctcagtaaatattggcaattactgca

SEQ ID NO: 90293 - DNA, 211 bp, Homo sapiens
tgacacagagcatgtattccatgcttcagaacaatttgacaataaaggaggagacataatctaaacacctgcctatgcatcagttaaggcagtgagagcagatacatctgtcatgtgtgctcagagaggagagcctccaccttagaggatcagagaaagcttccaggcagaggaaaggaacaatttaaggaggtttttgacagtgaataga

SEQ ID NO: 90294 - DNA, 815 bp, Homo sapiens
gtcccttttagctggagatggcaaaactctgaccatgtgtctgcccaaagagacatattacagagccatgccacgttgttctcccaccagaaaggccgtatggctgaattagagcgtgtggggattagaaatgcgctgctttcttgaaatggccaccagccttgtactaaacatgtttgaccggggccatctgtctgcccgtcaaaagtgtggtccagtttccatcagataagtctggaagaggacggtttttgttgttgttttgttttttgcatccagcttgttaaaagatatgaagaacgagaaagttttagctcagcaagaaatgtaacaatttaaagtttttattctgtcatgattctaaaagcctctagaattgtcatctgccttttcacctaattatacgcatatatacatactctttatatatatacactttgtatatattatgcatattatgtaaatatatacatatgtacacatatataatattcatataattatacacgtatacacatactatatagtatatgcgagtatatattatagcatgtattcagcatggtataatataaaggtctctaaagacaggcagacctatgaaaacatagctcttatcacctattactgagtgacctggggtactatgcttaacttctctaaaacttaaattatcatgtccagtccactggaaaataatagggcaaaatgatataatagtgacaaaacacataagcattcagtacaactagctcaataactacttattttaaaataaagtccctctggctctagaggatggaataaggaataca

SEQ ID NO: 90295 - DNA, 470 bp, Homo sapiens
gaaagcagtgcctggacaatcggatctcctaatgcctctgttaccccatccccaacatgtagaatcaaggtcaaacttaaggaattttggctagatcagccaggcgcagtgacttacgcctgtaatgccagcactttgggaggccgaggcaggaggaattgcttgagctcagaagtttgaaaccaacctgggcaacatggcaaaactccatctctacaaaaagtacaaaaattagtcaggtatagtggcatgaacctgtattcccagctactcaggaggctgagacaggaggatcgcttgaccctgggaggtcgagggtccagtgggccgtgctcacaccactgtactccagcctgggggacaaagtgagaccctgtcaaaaaaaaaaaaaaaaaaaggctggggggattttggttagctcaatttaattctctctggctctaccagagattgtagcccatctgctgggg

SEQ ID NO: 90296 - DNA, 352 bp, Homo sapiens
taagggtactcaaaaacgagattttgatgaaaaacaagaagcagctgacagcttcagtgagaattccaagctaaacataggccacgtgtttaccagaggtgaaccaacgaaagagacaactaataataggccccccttgtgtcagaacaaacctccagtactgacctcagaagctgttcctgtaggaaggcttgtatggcaaattgtggttacgtgtggttaattttagctctgagcatggtagtggctacccatcacccgtgccagcagctttgtatgtgttcctgaagcagcttgctgaagccaggataggcattaaggaccctgtcctgcaaatattggggaactgtgc

SEQ ID NO: 90297 - DNA, 195 bp, Homo sapiens
gttccaggtaatccaaaccatgcaaaaatgtagaagatcaagtaaagtcagtatctgatagaggctcaagcaggataacttttaatcctgccatgaagaaaagcttaactttaaaaacttggcaccagccagttctcccctcagggagcctgtggctttgggcttgaggaggttttataaaagcaagcaggactc

SEQ ID NO: 90298 - DNA, 1309 bp, Homo sapiens
ggaaaataattactattagagtatcatcataggtaatctggcaactaagcacatttgttctgaattaacagacttaactcagactcttatgtacataacctacagttacttttacataacagcagagttgaatagatgaaacacagattatgtggcccataaagtctaatattttatttaatagttaaattttaaaaaattcaattaaatattttattttatggagaatttaagatatcattcagaagtgcaggatgaagatttaatttgctaatagtttaatttgctaataaataaaaattaaaatattttaaaattaaatatttaatatagaaggtttgacatcattcagaagtgtgagataaggatttaattaaatcattaatgcttgaattggatgatgtagacaatatgttattttgtagaaagggaagagccctgtaccactattgattaaggataatgtaatcaacaatataaaatagaatattctaagatacaatgttttgaataatgtttatttctcatattaaaatgtattatttattcaacattgattcataaaatgggatgtattagattattgatttttaacttaaaaatgcatcatctttttctctatatcattcaaagcagaagtattttgaactttaagtgcgtttttagtaattttagtaataataaaatcatcatcttgtacctaagcagaattttactaccttaatgactacaaaaattactacaaatccttagattggtgatgtgctgatagtaactgaagaataaaaccacatagaggaaaaattaattttccatttagtcaaatggatgaatctattaagaagaatattaaaagtaatgcacaggcttgaaggccagtgaagacaatgttgagaattgaaaaacacaggataaggcaggggacggtggctcatgcctgtaacccagcactttgggaagcctcactgagaaacactttgttccgattaccttgtttctaaaaatattaaatatgaagtatatcagtctaaggatcctattaactgtccaatatagcaaaaaaaaaaaaaaatttaaaggcaagtagtatcctccctacttgcgggctgatcacttgagaccaagggaaaaacctcctgtctactaaaaatacaaaaaattagccaggcatggtggcatatgcctataatcccagctacttgggaggctgaggcacaagaatgatttgaacccaggaagtggaggttgcagtgagccaggatcgctctgctgcactccagcctgggcaacagagtgagaccctgtctaa

SEQ ID NO: 90299 - DNA, 157 bp, Homo sapiens
cttagactcatagagggagacaagacatgcaacagcaacgtgtgtacatatactaatgatatctgtggttttgtgctgggaggaggaaacagcagggaatcataggaagctggtccaaggggctccaatgaagaagtctcaagccaggttgctcaga

SEQ ID NO: 90300 - DNA, 333 bp, Homo sapiens
attatactcaacaatctactaaaattacttttcttcctattcccacagtcttggacttggtgtgtttggacataaaagtgctccagaaaaactaattcctctagaaacatagtttgattattatcagttagaagctgagagtgcaccctgacaattttattctactaaattggcatgcttctgaatcattatactgggcaagatgcttgatacccataacctagagtaaattagattatggctgcatgatatagcatgtaggactatgtctgggacctggagaatcacttgggtgtagctcagtgttcccatttcaataatagtaattaataa

SEQ ID NO: 90301 - DNA, 532 bp, Homo sapiens
tctgcaggaggagaaaacgcgagtgtcccagcaccacctggaccagcaactgaacagcgaggctcagcggagcaacagcctagtcgcccagctgcaggccatggtagctgagcgggaggccaaagtgcgacagctggagatggagatcggacaactcaatgtgcacgtgagtagggcactggcagcgcccaaacccattttcaagccgggcaagtccatccagctccttccacttctttccacttgccttagctcaggccagacttcatccttcctggctccactttggccacctgcttctatctggctccccaacccattctgcacacaaacctgattgtgtccttgctctacttaaaatctgttcatggcttactgtcaccctcgacctcacctggttctcaaggacccaggcaccttccagtttaccctctcccatccccagctgtggccttatcctcaggattcaagatggtggcagtagctccagcagcaggatgagagaaggaaagccacacttcattcagcttct

SEQ ID NO: 90302 - DNA, 425 bp, Homo sapiens
cttggtcatttatactgctgaaaaggtagctttcatatctttatgctcagctgcttgcaaggttcacaactttaggattggttctgcatgtgtaaagctatgcctgataaggcaaaagaggggtataaatgaatctcacctgaaattggagtcttgtacagtgaatgggtttacctggagttgtgttcatattgtgaacccagcttgttttaatggaggtttccattagtcttcctgcctgtgttctcagggtattataagaagcatgaagatgtgtgtgagctttctcttccttaatcacttgaaattgatcactgtctttgaataccggacccgtaaaaatacccttttaagaagtccttattttttcatttctttaattctctgccagaagtgagtggaatattgggtgtctgttttctaga

SEQ ID NO: 90303 - DNA, 410 bp, Homo sapiens
cccgggacgctagagcaggcggttcctgggctgctccggtagtttcgcgtgcgcgggtttctgcagatctagggcgagcttgcacgttacatcaccgatgcatctcttcttgcttgcttaatttgccaccacttaggcctttcttgcagaattcgccatatactccttaagggccgcggaatcggagcgaccttggtgactggcaaactctcggcagatgtgcgtgcactggtttgatgcagacgtggttgtaggcgatttaatttttcccagctttgcagcgactgttggcttcccagaacggatctccccagcctcgactggaagctgagggacaaaaattcataaaagcaattactctttcccggcgaggcttctagaagagcaagaagagcgatatgattacacct

SEQ ID NO: 90304 - DNA, 812 bp, Homo sapiens
ggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctggctcccagctgtctgtatcctcctgccccgccctggcgagtgcctaccctggcagaacccagggaggagtggaggctgcctctgcctgggcctccacacagcatcctgtacatacgccacctgggctgggggtggggaggcagggccaggagcatcgattaaagatcacatcctggggcttccagggagctcacacc

SEQ ID NO: 90305 - DNA, 398 bp, Homo sapiens
cccgcagcttaagggctacccaatatgggaggtggttttgtggacagtagcatgacttactagatagtatatgggtagatgtctaaaatggcagtctttgaccctaaggccttactgtatccgaagaatctgagtcagaacatgtcttagaataaaaagcaaagtagttaaagcacccataaacatgtgtggccttcacaacttgctaaagggtgcattcattgatttattcattcaggaaacatcgaatgtctgctatgtaacatgaattgtgtgtgaccatgaggaccataaaaaacaggtgattgagcaagagggtgcaacgtggggaggtagtgttactttggattagctgttgtggaaagtttgtctttggagcgacatttcagctgagacag

SEQ ID NO: 90306 - DNA, 286 bp, Homo sapiens
atctctccactgcactccagcctgggcgacagtgagaccctgtctctaaataaataaataaaagagaaaagctggctcgcaggagagacctaagggcacctagacagcactggccaggagagcagaggcgagtgcagcgtatatggaacaaaagcacccctgtggagtggacagaagcacagacctagggcttaggagaggaatgaaacaaaaattcctgtttcttcaggagctgaagatagagaaagtatctgtacagtgcatgtgcgtgtgtgtgttagtgata

SEQ ID NO: 90307 - DNA, 355 bp, Homo sapiens
gtgtaagccaccatgcccaaccctttctcaaagatttttaacccttagatatacctcagcataaattttctacattgtctggcatttagctacagaaacagtcattatataaattagcatctatattcagaatctgctatctcattgatatcttttgcagcatttttccccagctacccattgcatttagctgtcttgatctcatttcagacttgtacaatttatcctttgtctttcatgaaatggcattgatatttctgaggagtacaagctaatttttctgtagaatgttcctcaacatttttctgataattctgctagttcctcataattaaattttcattatacatttttg

SEQ ID NO: 90308 - DNA, 416 bp, Homo sapiens
ggaaacttgttgagttaaatttgctttttcctaattgtgcatctcgacttttcccatcaatcttatttctagagtctcttcacaaccggtgtctccctgcctccctgtctcatgatgttaccgagctattcagaaaagaaagtgcagggctgggcgcggtggttcacgcctgtaatcccagcactttgggaggcctaggcgagcagatcatctgaggtcgggagttcgagaccagcctgaccaacatggagaaaccccgtctctcctaaaaacacaaaattagccgggcgtggtggcttttgcctgtaatcccagctattcgggaggctgaggcaagagaatcgcttgaaccctggaggcggaggctgcggtgagccgaggttgcggcattgcactccagcctgggtgacaagagc

SEQ ID NO: 90309 - DNA, 995 bp, Homo sapiens
taataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaggtaaagtgcccgaacctgctaatgaaagaggtgtctgtgtggcctggattcctgaggttcagccacaatgtgtcttgcagaattattttattttgctagtttttaatttctcaaacagttcagctgcctgtcccgtggtaccgtgagacttctaattcaagatgaccagtatttgcagacagagccactgcctttgctgccacattttgcttggttattgtgtgagaacaccatttttctctttttaaatgaattgtgtttctctttttaaattgagcatctgactgggcgcggtggctcacgcctgtaatcccagcactttgggaggccacggtgagtggatcacctgaggtcaggaatttgagaccatcctggccaacatggtgaaactcctgtctctacttaaaaaaaaaaaaatgcaaaaactagctgggcatggtggtgcacatctgtaatcccagccacttgggaggctgagggcaggagaatggcttgaacctgggatgcggaggtcatagtgagccaagactgtgtcattgcactccagcctgagcaacagagagagactgcctc

SEQ ID NO: 90310 - DNA, 2908 bp, Homo sapiens
gcgtttactggcaaaccgcatttgtaaatgtgctggctgagccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccatggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctctcgctgcagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatccggctgggtccagtgcagtaagcagccccaacagggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccatcgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcacctggagggatgcccccaggcagccaccagtggacctagcctggatggcccctccttgcaaccaggcagctgagaccagggtcttatctctctgggacctagggggacggggctgacatctacattttttaaaactgaatcttaatcgatgaatgtaaactcgggggtgctggggccagggcagatgtggggatgttttgacatttacaggaggccccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcgggggggggttctagaaaatataggttcctataataaaatggcaccttcccccttt

SEQ ID NO: 90311 - DNA, 2890 bp, Homo sapiens
gcgtttactggcaaaccgcatttgtaaatgtgctggctgagccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccatggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctctcgctgcagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatccggctgggtccagtgcagtaagcagccccaacagggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccatcgctggggctgtcctggttgcagccatcgtcctgggcggcacgggctggggatttaagtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcacctggagggatgcccccaggcagccaccagtggacctagcctggatggcccctccttgcaaccaggcagctgagaccagggtcttatctctctgggacctagggggacggggctgacatctacattttttaaaactgaatcttaatcgatgaatgtaaactcgggggtgctggggccagggcagatgtggggatgttttgacatttacaggaggccccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcgggggggggttctagaaaatataggttcctataataaaatggcaccttcccccttt

SEQ ID NO: 90312 - DNA, 3178 bp, Homo sapiens
atgaggctgctgcggcgctgggcgttcgcggctctgctgctgtcgctgctccccacgcccggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccatggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctctcgctgcagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatccggctgggtccagtgcagtaagcagccccaacagggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccatcgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcacctggagggatgcccccaggcagccaccagtggacctagcctggatggcccctccttgcaaccaggcagctgagaccagggtcttatctctctgggacctagggggacggggctgacatctacattttttaaaactgaatcttaatcgatgaatgtaaactcgggggtgctggggccagggcagatgtggggatgttttgacatttacaggaggccccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcgggggggggttctagaaaatataggttcctataataaaatggcaccttcccccttt

SEQ ID NO: 90313 - DNA, 932 bp, Homo sapiens
aattcggcatgaggtggcagccaaagcccctccctgagagaagcaaaaggtcagatgtctccttttcctctccccttccaccatcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcacctggagggatgcccccaggcagccaccagtggacctagcctggatggcccctccttgcaaccaggcagctgagaccagggtcttatctctctgggacctagggggacggggctgacatctacattttttaaaactgaatcttaatcgatgaatgtaaactcgggggtgctggggccagggcagatgtggggatgttttgacatttacaggaggccccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcgggggggggttctagaaaatataggttcctataataaaatggcaccttcccccttt

SEQ ID NO: 90314 - DNA, 682 bp, Homo sapiens
gaaggcgccatcctgcctgccacaggaagggccttggactgagaggaccggagctgactggggattattcaaagccaaaagccaacagagcccccatggagaagtggaggatgctcagatactgctatggagccctgagaagtgaaatgggtccaagcccttgcccaggatagagcgctccaagcgcatcctccggggacccttttaatcagtgaattgttcacctctcactgtttcttcccagcagagctaagagacttctagagcctcttgtggatggtcagcgatagccctggtatgaccaggaggtggcgatttctgttctaggtccctcagcaaagactaagcaggacaagcctggctactgtgttaggaggagctgtagggaaagggaaggacaagatgggccaccacatgcctgtgtccactgctggccacacccagagtgctaggggtttgtggcagtgactggggccacctagagcagttctagggttcgtagtcattctctctgagtcatggaaaactgcccaggaggcgagtcccacctaagagagtatgtgtagcactggcacggcctgctgccttgcaaatgaccacatttcatgaaagaaagccagggccacagacaggaaccaaaggaaatcagtcacttaggggaagataatgaatccacaaagtg

SEQ ID NO: 90315 - DNA, 339 bp, Homo sapiens
aaggcgccatcctgcctgccacaggaagggccttggactgagaggaccggagctgactgggggtaagtgcggctctcccccggagcctgccgacccccctgagtgatcaggccgatctttggggtggccgctgaccgagaaatgacgggaggctgctgactccgacgttgaaaaaaaaaccacccaacgcctgagcaacaggaggtgtagaacacaccataactttgtcttccatgattattctgtttcctcagaaagcttgaggaaaactggagactttctttagagagagtaacagatggtttccgtttaaagaaaaataacaaaatggcttaagga

SEQ ID NO: 90316 - DNA, 413 bp, Homo sapiens
tttcaccgtgttagccaggatggtcttgatctcctgaccctgtgatccgcccgccttggcctcccaaagtgctgggattacaggcatgagccactgcacccggctgaagcatgggatttttaggcaatgaaactattctgtatgatcctgtaatggtggaaacataacagtataaaaaactcatggaactgtacaacaccaagagtgaaccctaatgtcaactatagacttcagttaattttaatgtatcaatattgtctcatgattgtaacaaatataccacatgaatgtaagatactaataataggggcaactgtcagtgggcgataaagagggtatgtggaactctctgtaagatcttcaaaatttttggaaaaacctaaaattgctctaataaattaagtctgttaatg

SEQ ID NO: 90317 - DNA, 522 bp, Homo sapiens
cgggcaaagaacttgagtggccgtctctccaaagaagatgcacagatggccagtgagcacatgaagagatgcctggcgccatgagtcattagggaagtgcaagtcaaaaccacacacgcgttgggatggctgttaattaaaaaaaaaaaaaagtcaccgtgttggcaaggatgtcgagaaattgaaacctttgtgcgttgtaaaatggtccagcctctttggaaagcatggcagttcgtcagcgagttaaacatagaattatacccccaagattgataagcataaaacccaaaagaatcgaaagtaggagctcagatacaacaatgtccacagcagcatcattcacaagagtgaaaggccggaagcagcccaagcattcatcagcagatgagtggaaaataaaattttcatacaagggaatattattcggccttaaaaaggggttggcagggctcggtggctcacgcctgtaatcctagcactttgggaggccaaggcggacagatcatgaggtcaggagtt

SEQ ID NO: 90318 - DNA, 144 bp, Homo sapiens
tacaatattgctcgagtctttgatttccttttaatcttctgccaaacgttctatccattatcaaaaatgggatattgaagtctccaattatgccagattttgcttctcctagaagcagaaggcatggcaccccacatagggcca

SEQ ID NO: 90319 - DNA, 436 bp, Homo sapiens
gtagactttaagcaagtaccggcttgtattcatctgtttgtcttcaggacctaaccaatgcttggcacagaatcagtaccaagtgaagatttgaaagaaaggaaaagagaagtgcctttaggcactttaaatagttgaagatagcagtactatcccctcaatggctaaacatcttccttcacctggtttcaagttcccttcactcttctctggctgttctgctaatagtcaaggcccctgtgacaagagatttaaatcagtgaagtagccttgtgaaagaggatggtctgttgggagacagaagacctggttttatttaagcccgttttcatgatttcctgtcattcacctcttcaagcctaagttgccgtttttatagaacagagatattggtccttctctcacagggtttctcagggaataaactgagataata

SEQ ID NO: 90320 - DNA, 362 bp, Homo sapiens
tcaccacccactgtacagtgaatgaggccatcttagatcattcagccccaagtaagtcaccaaactgtagccacatgagactgcaggtgagatgagcagaagaaccccctagctgagtccaccttaaaactgccaatccagagaatcataagcaaataaatggttgtctcatgccactaagtttcggggtagtttgttacacagaaagagatgacagaaacacccctataacactcataccacttcttctcccaggtatcttgccactagcacctctttttgggcactttgggggccctcactcctctgcaggtgctcttacattcttggcttgtatcaggggtcaagacctgcttccaaat

SEQ ID NO: 90321 - DNA, 353 bp, Homo sapiens
  misc_feature (262)..(262): n is a, c, g, or t
  misc_feature (351)..(351): n is a, c, g, or t
aagaaagccttttaaaaccccgtgcatttgaagtgtttcttatttataggctttagtatctgcagtgtgacagagacagcatgagagcatcatacctgtgaaaaaggtcttaagatttaagtaagttcaaatgtatctttaatttttagcaggatgctgtcttcacaccctcctaacactccacccctcattgatagcttcctaatattatgttgctgctctgcgaccagcccagtagtcccatttccttccacaccaaaangtgttaaatcaagtatgcaaatggggtccttacactggggtttatgttgtcttgccctttttttagcacaaaaaaattgtacttttttntt

SEQ ID NO: 90322 - DNA, 2589 bp, Homo sapiens
  misc_feature (15)..(16): n is a, c, g, or t
  misc_feature (87)..(87): n is a, c, g, or t
  misc_feature (396)..(396): n is a, c, g, or t
aaggagcaggaaagnnttaaaactgcaggcttctggattatccacccttacagtgatttcaggttttactgggatttaataatgctnataatgatggttggaaatctagtcatcataccagttggaatcacattctttacagagcaaacaacaacaccatggattattttcaatgtggcatcagatacagttttcctattggacctgatcatgaattttaggactgggactgtcaatgaagacagttctgaaatcatcctggaccccaaagtgatcaagatgaattatttaaaaagctggtttgtggttgacttcatctcatccatcccagtggattatatctttcttattgtagaaaaaggaatggattctgaagtttacaagacagccagggcncttcgcattgtgaggtttacaaaaattctcagtctcttgcgtttattacgactttcaaggttaattagatacatacatcaatgggaagagatattccacatgacatatgatctcgccagtgcagtggtgagaatttttaatctcatcggcatgatgctgctcctgtgccactgggatggttgtcttcagttcttagtaccactactgcaggacttcccaccagattgctgggtgtctttaaatgaaatggttaatgattcttggggaaagcagtattcatacgcactcttcaaagctatgagtcacatgctgtgcattgggtatggagcccaagccccagtcagcatgtctgacctctggattaccatgctgagcatgatcgtcggggccacctgctatgccatgtttgtcggccatgccaccgctttaatccagtctctggattcttcgaggcggcagtatcaagagaagtataagcaagtggaacaatacatgtcattccataagttaccagctgatatgcgtcagaagatacatgattactatgaacacagataccaaggcaaaatctttgatgaggaaaatattctcaatgaactcaatgatcctctgagagaggagatagtcaacttcaactgtcggaaactggtggctacaatgcctttatttgctaatgcggatcctaattttgtgactgccatgctgagcaagttgagatttgaggtgtttcaacctggagattatatcatacgagaaggagccgtgggtaaaaaaatgtatttcattcaacacggtgttgctggtgtcattacaaaatccagtaaagaaatgaagctgacagatggctcttactttggagagatttgcctgctgaccaaaggacgtcgtactgccagtgttcgagctgatacatattgtcgtctttactcactttccgtggacaatttcaacgaggtcctggaggaatatccaatgatgaggagagcctttgagacagttgccattgaccgactagatcgaataggaaagaaaaattcaattcttctgcaaaagttccagaaggatctgaacactggtgttttcaacaatcaggagaacgaaatcctcaagcagattgtgaaacatgacagggagatggtgcaggcaatcgctcccatcaattatcctcaaatgacaaccctgaattccacatcgtctactacgaccccgacctcccgcatgaggacacaatctccaccggtgtacacagcgaccagcctgtctcacagcaacctgcactcccccagtcccagcacacagaccccccagccatcagccatcctgtcaccctgctcctacaccaccgcggtctgcagccctcctgtacagagccctctggccgctcgaactttccactatgcctcccccaccgcctcccagctgtcactcatgcaacagcagccgcagcagcaggtacagcagtcccagccgccgcagactcagccacagcagccgtccccgcagccacagacacctggcagctccacgccgaaaaatgaagtgcacaagagcacgcaggcgcttcacaacaccaacctgacccgggaagtcaggccactctccgcctcgcagccctcgctgccccatgaggtgtccactctgatttccagacctcatcccactgtgggcgagtccctggcctccatccctcaacccgtgacggcggtccccggaacgggccttcaggcagggggcaggagcactgtcccgcagcgcgtcaccctcttccgacagatgtcgtcgggagccatccccccgaaccgaggagtccctccagcaccccctccaccagcagctgctcttccaagagaatcttcctcagtcttaaacacagacccagacgcagaaaagccacgatttgcttcaaatttatgatccctgctgattgtcaaagcagaaagaaatactctcataaactgagactatactcagatcttattttattctatctcctgatagatccctctagcctactatgaagagatattttagacagctgtggcctacacgtgaaatgtaaaaatatatatacatatactataaaatatatatctaaattcccaagagagggtcaaaagacctgtttagcattcagtgttatatgtcttcctttctttaaatcattaaaggatttaaaatgtcgttgtaagatta

SEQ ID NO: 90323 - DNA, 382 bp, Homo sapiens
atctccatgtgtttcaaaagtaggaagaacagtaggagcatagtagctggggaagattgatgagagatgctgttggagaagtgggctgagcagaaagcatgtgttatgtagggatttgaaggccaggttgaggaattcagatttaaactgtgaagggaaagtactcaagagcattgtttcaaaattcaagtagtcagggttggatttttcttacgtttctcctacagaaggagaaaacagcatagataatttgtaaatcaaataaatatgttcctatgtaattaggaactatttctgtatacatatgaccctataactgatttctttcctttttttacataattctgcagttaaggaagacagttttttagaattataaaag

SEQ ID NO: 90324 - DNA, 2431 bp, Homo sapiens
tgttttaatgagaatgggcgattcatttaaaaaagctttgtttagaatatgcttggggccgtaagctcagaatgagggcagggaccattttggattctgagagtcgatgccatttggtccaggagtgtgtctacagtcccctgcattccagctagtttcttggggattgaaacttatgtgaagggcatttcacctgttcagttgggccaaaggtcaaaacgtagcaatacttggggaaagaccacataaagtcacactgcaagtgctttccctctttccccctacacacagggcacgtgctttttcttggattgcagacaatttttacagtttttttctgactttattgtgaaagtttgtttcaagcatttcttgatatcatgttatgtactatttttatgatttagtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttaccttttattttttcgttaagcctctattgtttgtagaacactcttagaaacttggaaataaaatgtctttcccaactagtggagtcctttttcatttggagcacattgccttaaaagaagtcttaatttaaacggtccttccttattctaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggagattaggccagctgtggcaattctggacagatcttgggtttagctaagttatttcttttaggcctgggtttctgggggtgacagggaagataaaagagtagtttatttgcacctcttggagaattgcttaaaaatatagagatcatggctctgtatgtcaggtggaaccaggtcaggagtatttgaaactgctcctgggtcattgtgacatatccttcacatctttttgagaaactttataagacaatgggggtgaatgggggctgggcagttggagtctctgagcaggagcaggggcaaaatttatttggcaggcagtgtggaggacagattaggagcatataaacccagaggtgtgccccaggagggcttttgcaaaggtcaaaatgagatagaatgagggcctgaaataattcagtaatttggagatggagaagaggaaagacttctctgctcttgcactgccatcagcctggtctgggccatggtcatctctgacccggaagactgaccccacctcttggctcaccctctgcctcccaacctcctcttcacaaagaagccagagggatacttttaacacacaacccagatcacatgacttcgtaacttaaacctcttcactggcttcccaaagacttaaaatgaattctgatgcctttattttattgctttacatgaacagggccctgcgaacctctccagtgtcattccactccatcctcctttcagtgcacgatgctccagccacactggccatctttcggttcctgatacaaaaaaaaacacgttccttttccatggaaagcaggtcacccttgttattttgtatcgatgacaactctttaaacttattttgctttttggctttatgtatgtgtgtgggtgggtgggactgactgccccactagaatgtaagctccatgagggcagggaatcttgctttcttgtttaccattgtatactcagttctttacacagtgcctgaaacataacaggtacacaataaatatctattgaatgaaaaaaaata

SEQ ID NO: 90325 - DNA, 954 bp, Homo sapiens
tgttttaatgagaatgggcgattcatttaaaaaagctttgtttagaatatgcttggggccgtaagctcagaatgagggcagggaccattttggattctgagagtcgatgccatttggtccaggagtgtgtctacagtcccctgcattccagctagtttcttggggattgaaacttatgtgaagggcatttcacctgttcagttgggccaaaggtcaaaacgtagcaatacttggggaaagaccacataaagtcacactgcaagtgctttccctctttccccctacacacagggcacgtgctttttcttggattgcagacaatttttacagtttttttctgactttattgtgaaagtttgtttcaagcatttcttgatatcatgttatgtactatttttatgatttagtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttaccttttattttttcgttaagcctctattgtttgtagaacactcttagaaacttggaaataaaatgtctttccca

SEQ ID NO: 90326 - DNA, 1484 bp, Homo sapiens
tggtataaaacagtgattactttagaataaggaaggaccgtttaaattaagacttcttttaaggcaatgtgctcccaatgaaaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggagattaggccagctgtggcaattctggacagatcttgggtttagctaagttatttcttttaggcctgggtttctgggggtgacagggaagataaaagagtagtttatttgcacctcttggagaattgcttaaaaatatagagatcatggctctgtatgtcaggtggaaccaggtcaggagtatttgaaactgctcctgggtcattgtgacatatccttcacatctttttgagaaactttataagacaatgggggtgaatgggggctgggcagttggagtctctgagcaggagcaggggcaaaatttatttggcaggcagtgtggaggacagattaggagcatataaacccagaggtgtgccccaggagggcttttgcaaaggtcaaaatgagatagaatgagggcctgaaataattcagtaatttggagatggagaagaggaaagacttctctgctcttgcactgccatcagcctggtctgggccatggtcatctctgacccggaagactgaccccacctcttggctcaccctctgcctcccaacctcctcttcacaaagaagccagagggatacttttaacacacaacccagatcacatgacttcgtaacttaaacctcttcactggcttcccaaagacttaaaatgaattctgatgcctttattttattgctttacatgaacagggccctgcgaacctctccagtgtcattccactccatcctcctttcagtgcacgatgctccagccacactggccatctttcggttcctgatacaaaaaaaaacacgttccttttccatggaaagcaggtcacccttgttattttgtatcgatgacaactctttaaacttattttgctttttggctttatgtatgtgtgtgggtgggtgggactgactgccccactagaatgtaagctccatgagggcagggaatcttgctttcttgtttaccattgtatactcagttctttacacagtgcctgaaacataacaggtacacaataaatatctattgaatgaaaaaaaata

SEQ ID NO: 90327 - DNA, 505 bp, Homo sapiens
aagctataaaacagatggatcaaggcaaaacaagaatcccaaagataacctttccatcttttactataactatttaacaggtagggatctgggaatatctttagagatattttccacaaagctgggtgttatctacagactgtcatattggtgggccttgtagaagagcaccatctactggcaaaactctacttttatttcagattcatcctttaaacttactaggtatgggattgaaatacaaaccaagtacagtcatgcgccgcttaatgatagtgctatgttcggagaaatgcattgttaagcagttttgtcatcacacaaatatagagtgtacttatgcaaacctagatggtatagcctactacacatgtaggctatgtggtttagccagcccattgctcccaggctacaaacctgtatagcatgttactgtagtgaatactgtagataattgtaacacagtggtaagtgttgatatatttaaacatacttaagcatggaa

SEQ ID NO: 90328 - DNA, 191 bp, Homo sapiens
  misc_feature (8)..(8): n is a, c, g, or t
ctctaganatccccctcataatgtgcgcccacagcctcacctctcctccttgtcccttgagggtgggcaaggaaacagacagtgaccccagcccctctggccagtgcaagaggctgcagggcctgacattctcatcatggaaagaagacttttttttttttttttttttttttaggagacacagtctccct

SEQ ID NO: 90329 - DNA, 178 bp, Homo sapiens
aggcacttgcagcatcactaatggcacgttgtatgggtcccatggtgttactgaagatttacagtactgcaccaaacatgatgaaaaaacacaagaactgacagagatcccttttttttttttttttttttttttttttttttttttttttttttttttttttttttttttttttttt

SEQ ID NO: 90330 - DNA, 160 bp, Homo sapiens
ggcaaagctgcccctcacagagtgtttctatcgtttctcttcctcctccacctggtgaacccctacacatactccatggtccagttcaaatgctaccacgtgtataatgccctctcctacccacagagtcggggtaacttatcattccctcacctcactc

SEQ ID NO: 90331 - DNA, 507 bp, Homo sapiens
tgagacggagtttgctttgttgccaggctggagtgcagtggcgtgatctgggttcactgcaatctctgcctcccaggttcaagcgattctcctgcctcagcctcctgagtagcttgaattacaggtgcatgccaccacacccagctgatttttgtatttttagtagagacggggtttcaccatgttgaccaggatggtctcgatctcctgacctcgtgatccgcccacctcagcctcccaaagtgctgggattataggtgtgaaccaccgtggctggcctcaccagctattttttcatggttctacgactttgtggttgtccaacctgggcaagtaaacctctttgagtctcagtttcctcaaacataagagccatctttagagaattgttcgagctttaagaaagtaatattaagaaaagtgcctggggcataataaggactcaaggaaagttagctattctattgccattcttcaagcttgctgtcattcactgtcattattact

SEQ ID NO: 90332 - DNA, 310 bp, Homo sapiens
tcccactaggacccacctcccaacactactgtgttggggatcaaggcttcaggagtttggttgggaacatcccacatcccagctatagtgaggctgcactgagctgagcaggaaagcctcaaaggcctggtctgtcatgaggaccttgtaaactcagctctccacagtcccagtgaggtgcagaaagagaccccagcctagcaacgtcaccaggtacctgtcaacttccttcatatatggaacctgcaggcttctcaggaagctcatggagtgggcagctgtccagtcaggggtgggaggagcccaggta

SEQ ID NO: 90333 - DNA, 156 bp, Homo sapiens
aagcccccgtcctgagtctgacacatggagagggctaggccatcatgaatgtcctttaaacagaaacattccccatatccccttttcccacattggttgacatgccgtagcgcaataatctcacaaacttgattatcccagaattaagctatgcag

SEQ ID NO: 90334 - DNA, 417 bp, Homo sapiens
gaaactttgagagtagctatttagacttcataatgtaagcatcataaacactactcctcattgatgctgaaaaccattactaaatttttgagttcttattacattcacttttgtatattttcttatttaatttttgtaacaatcagataagcaaagagaagcacagagacttagccacaatcccagtgagtggtatcagagcccggtacatttaaattcaatgatttcttgttgaactacttccattctttttggttactccaaatagccaggactagcccctgtataagattatctatcagaggttgttaagcctgataccttgttatgctgaggtcttttccccttgagaagaggacttaacaatggattggccacaggtgacaagggaaacaattcagcaaatgtaaatcacca

SEQ ID NO: 90335 - DNA, 494 bp, Homo sapiens
gtgagttgctaaaagcagccttcattagggcttcttgatgccctggcaagatgtcactctgaacagatagaatatcagcacccttcagaattcaccttccaagaggaaatttaggcaacttgagaggcatcgctcactgaataactcacaccctcttctgaaaatgtagcctttgagcttatctcagtaaaagataatgcctctacaatttaggtaacagagtgttgatgttcactcaaacccgttcttctgttggaccactacaagagattaagtaaattgatcaaggttacgtgacagaatttgaacccaggtctgtaggtcttgacttcaacccatgatcagttaggttgatcctgttagtggggagacttccctctaaggccagctgtctgttttatagaagcagatttgtgaaatgcatcagtgcatgtattagtcctttttcacactgctataaagacctcctgagactggataatttataaaggaag

SEQ ID NO: 90336 - DNA, 520 bp, Homo sapiens
ctaaagataaattttaatctggaataacggaaacttatatataacttcacataaatttatgcatacatgtacatatactttttaaaggcacaatgatggaaaacattaaatatagccataaaaattaagaagaatatagatctaggataaaacagggcaacaagccaataaaagcaagtagatggtccaaatatagaacctacattataaaatataacaatttataatttactaataatgttggggcaattaacaatgaggaagaataaatttaattctcttttcatacaatatgcccaagtaaattcaataatcactaaagcatatttttaaaactccagaataaaacactaatgtttacagagggttagattttgtagggttggaagaaaatagaaggattgaaatatataaaaattgaaacattttcaaaaaataaagaaaataccaaagagggaaaatcatttgcagccaagatgacaacaaagaattaatatctttattatgcaaagagatggtt

SEQ ID NO: 90337 - DNA, 599 bp, Homo sapiens
gaggcaggatctcattaggttgacaaggctggacctgaactcctgggctcaagtgatcctcctacctcagcctcccatatagctgagattatagatgtggatcaccatgcctgactagttttctttctttagtagtcaataaggaatacagacttagtagtagtgcctattaattataatttgaggttcataaaacagcctatatcccttatcagcaagtgataacactcaggtaaaatgttaaatatctttatataatccccactagaatgtaaacttcataaaggtagggtctttgtttactgctgcattcccagtacttataacagtgagttattagataataggtaatttataaatatttattgagttaatcttccagccatccctgaattcagcattgtattcacgactctttggaatcaacaaggtttcctagtttagcggagaaacaataatagaataatcttggctattttaaagatttggaatattaaattggaaggagggcaatgattatgtaaatgtatgtattaagggactaatgagaggtgatatatatatctcaacagtagaaagtaaaaatggtgactaaaaaa

SEQ ID NO: 90338 - DNA, 486 bp, Homo sapiens
aggtggagaactgacataatattcgtattggaagatcattttgtatatcagctatctattgctgtgtaacaaaccaccccaagcttaatggtataaagttacaatgatgcttattagtcttctcacaacactggaggctgacgagactcacgtaggcagtactgcctttgtatgtcttatgtggttgccttcaaacagtatgcagttagaatagtctcaatggtttccttgctcaaatatctcctggttaatatgggctgttagctagggcctcagctggggctatctggtggaacacccacacatcacctccatacgtggcctgggctttctcacaaaatggtgaatgggttctaagtgcatccatcccaggaaggacagccaagtggaaacagtgtcatcttttatgacctaactttggtagatcatgtgcaacacttccactgtattccaattatagaagcaggggactaagttcatattcaa

SEQ ID NO: 90339 - DNA, 451 bp, Homo sapiens
ataagaaaaagaatagatcaaagaaaatcttgatttcagattctttgggatatcaactcatcactgctgttttctagaacccacaatctttaaactttaacacaattggggaatctctaaacaaaagatggcatgagccactgcgcccagccccccacccctttttaaaaactcctattctctgtagaaatttggtatggattagcttttttttatttttgaaacagggtcttgttctgttgccaaggttggagtgcagtgtcacaatcatggcccactgcagccttgatctcccagactcgagcaatcctcccacctcagccttccaagtagccggcactacaggcgggtgccttcacaccctgctaagttttttgattttttgagagataaagaaagtctcactgtgttgcccaggctggtctcaaactcctgagctcaagtgttcctc

SEQ ID NO: 90340 - DNA, 515 bp, Homo sapiens
acacacacacacactcacggccttgactccacagccttcactcctgactggacctcctctgaacagaggcttcctgtgctatggaatgcgattcctgctggctgaggagaagtggctttcaggccgctgggcaggggcgcctcttacttcactgagtgtggctgccaccacttcagcagcttctcctcctctcctgctaccccgaacacctcaaccccagcctgagtcccgctgcctctatttcctgttacctcagagggctcagctgccaaccaagacgcctgcgggtggcctcagctcctgagtgctggacaccctgtgacttaaaccccctaatacctcagcaccaaacatgcacggagcgctttggctgtccagggaaagcagggcagaagccggggagcacagattttggagccacacagggtcaaatactcagtctgccccgtcctagctgagtcactgaaagcaagttgcccaacctgtctgaacctcagtgtgctcgtctgcaaaat

SEQ ID NO: 90341 - DNA, 1152 bp, Homo sapiens
ctgacatggcaccctgggggtcatgccttagggaaagctgcttccactcgcccctgttttagctcatccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctc

SEQ ID NO: 90342 - DNA, 2907 bp, Homo sapiens
gctagtagagcccgggtgtttaatcggccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctgtcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccgtgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 90343 - DNA, 1093 bp, Homo sapiens
aaaaaagcggccgctgaattctagaaaaaaaagcggccgctgaattctagaaagaatttcatcaaaattaacatacacaattttcactcataatttaaaatattttgatgaaattctttgctttcacctagaattcagcggccgctgaattctagggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctgtcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccgtgggaggtgcagtggctgaagctggagaagatgatcaatactctgatcctcaactactgccagtgcctgctgaagaaggaggagtactatgaggtgctggagcacaccagtgatattctccggcaccacccaggtgcgcggggctgcaggggcggacagtgagggggcgcccagcccagggccacggagacacctgccatagccttcctggacttttctttccaccccaccagggcaccaaaccttgtctccacccagccgg

SEQ ID NO: 90344 - DNA, 2869 bp, Homo sapiens
aaaaaagcggccgctgaattctagaaaaaaaagcggccgctgaattctagaaagaatttcatcaaaattaacatacacaattttcactcataatttaaaatattttgatgaaattctttgctttcacctagaattcagcggccgctgaattctagggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatcgttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccgtgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 90345 - DNA, 1995 bp, Homo sapiens
ctgacatggcaccctgggggtcatgccttagggaaagctgcttccactcgcccctgttttagctcatccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 90346 - DNA, 3058 bp, Homo sapiens
aaaaaagcggccgctgaattctagaaaaaaaagcggccgctgaattctagaaagaatttcatcaaaattaacatacacaattttcactcataatttaaaatattttgatgaaattctttgctttcacctagaattcagcggccgctgaattctagggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctgtcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccgtgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 90347 - DNA, 2923 bp, Homo sapiens
aacggctaggtacgaggctgggtgtgtaatcggccgagggcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctgtcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccgtgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 90348 - DNA, 3034 bp, Homo sapiens
aaaaaagcggccgctgaattctagaaaaaaaagcggccgctgaattctagaaagaatttcatcaaaattaacatacacaattttcactcataatttaaaatattttgatgaaattctttgctttcacctagaattcagcggccgctgaattctagggacacctccctttctcctgcagccatggatgccgctctgctcctgaacgtggaaggggtcaagaaaaccattctgcacgggggcacgggcgagctcccaaacttcatcaccggatcccgaaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctgtcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccgtgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 90349 - DNA, 2170 bp, Homo sapiens
aggtagtgacagggccgtgaccggttgttatttcagtcacgggctgggcttaccagtgattactgggccgccaccagcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 90350 - DNA, 982 bp, Homo sapiens
aaaaaagcggccgctgaattctagaaaaaaaagcggccgctgaattctagaaagaatttcatcaaaattaacatacacaattttcactcataatttaaaatattttgatgaaattctttgctttcacctagaattcagcggccgctgaattctagggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatcgttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccgtgggaggtgcagtggctgaagctggagaagatgatcaatactctgatcctcaactactgccagtgcctgctgaagaaggaggagtactatgaggtgctggagcacaccagtgatattctccggcaccacccaggtgcgcggggctgcaggggcggacagtgagggggcgcccagcccagggccacggagacacctgccatagccttcctggacttttctttccaccccacaggtaccaacttgttcaccagcggttcccgagtggtactgatgtggtgtggtggcggcttggcggggcctttttattggtggcctccgggcccctgttccggggcggcta

SEQ ID NO: 90351 - DNA, 644 bp, Homo sapiens
  misc_feature (18)..(18): n is a, c, g, or t
tcaagccatgggcctctngcgaaggcgccggcgtgcccacggctaagaaacttcctctttctgctcccgggaacgaaggctgtagcagagaaggccttcaagtttcgagacccagttccagccgcagctgagcactggtgaccttgaattaagtctaatgttgggattggaagacgcttcagacatccgctgccgccctgggcaagcgaccagctcaaggttaccccacagggacgtgctctggtcccacggtccagtgctcttttgtcggttagttttgtcatttgtaaaataggaacagtagatagtggtaggaaagtggttgtgaaaacttaatagaaagctaagcgccttggtcgggcgcagtggcatgtcacccctgcaattctatcactttgggaggctgaggcgggcggatcgtttgagcccaggaattcgaaaccagtctgggcaatatgaaaccccatctctgcaaataaagtacaaaaaattaagagtggtggcgcgcttctgtggtcccagctactctggaggctgaggtgggagggtcaccagagccccggacatcgaggctgcagtgagccactatgagcgcgccactgcaccccatcctggcgacagagcgagacgcagtctcgaacaaa

SEQ ID NO: 90352 - DNA, 266 bp, Homo sapiens
agggagaaggattgggaacattgtttagggaagagacttttttactgaacttactttatactgtcaagattttataccagacacatatatttttctttttttgaggcaaggtcttcctctgtcacccaggctggagtgtggtggtgtgatcactgctcactgcagcctccacctccagggttcaagcgatcctcttgccttagcctccggagtggcatttgtcactatacccagcttttttttttttttttttaatttttttgtag

SEQ ID NO: 90353 - DNA, 1662 bp, Homo sapiens
cctttactaacatttattttgattttaaggtaatttttatattataggttacttgctgactttttttcttctctgttcttttctgaagttgcattcttgtgttgggtgggacacagttaagtgtgacatgaatttccttgccccaagttcttgatttgcccatgaaatgaagacttgtgcctcatcagatgtcttttaaattttttactctgcacattttattttaattatctctgaaggcattttctggttctgtaataagttcttacctcttgcctatagagactttggaagtgataaaaattgatctaaaactgttaaagaaaaaaatagtattttaaacctgttaagttattgtttaatcctagccttgtaattgatgtgcacagttgtagatggtggttgatttgctttattttgtattctcaatgccatataccatgtgtaagctatgtttttagcccggtctcatgtctcaattctgaaaatgtggaagatgtttattgtagtattcctataaaaattcattatcatttaattcttagaaaagtaactctagagttgttaaaagtctaaatggcctttttctgtgtttatctttaccagttcaaaatagaaatgctacttttaactattacaatttaatggtgtatttgatataaattggatgtttacgatttgagtaaagtacctgctttcgtagaatattttagctgaaaataattggaaggtatacctcccagtgttaaactctcctataaacattttcttcttacaaattggtatttctgaaccactatctcttattcctgtgtttgagtagatacaattaagtttcatactaaaataaattttcttcacatcattactaaagcattcagttatttcaaaaatatagtacattactatactgatgaataatggaagaagtttgtctgttgattcaacatattcaagagtaggatagtttttctcctgaataaaactacaaaatcaatagtggatttacttacttgacctcaaagagataagacattttgtctatgaaatagtttatagttttttgtttgtttgttaaacaaaaatgaagggaaataaaccaataaagcagaaggcatggattgaggaagcaatctgggaaaggttgtgaaaagaattgccagagtcttggtcaaggggaatcctagcaagccaccctgcagaggtcgcaggaggatggaagaactcttgggaggaagctctctaactggagggctatcatttacaaagccatgatactataaacactgagtattgagttaacaaaaaattgtaagactagtgtgttgagaagttagagtatggaaaaaaggggaaaagggacagtttgggatgaggtagggaggcagatttattcatggaagcttttctatacagcaagaattatgagccatacctttcagatagttctgtgggttggcagccctcatcacctggcacctttggcactgccttgatagctgcctctcacccaagttagagaaagaggattgaagacaggaagaaagcaagcttatgtgcttgatactttatcctaactaggtatattcttatttccgccctttttacttgaggcacagatacaccatcatctgcactttctgtgcctaacttatcttaaca

SEQ ID NO: 90354 - DNA, 930 bp, Homo sapiens
ggaaccctcacccagaatgaaatgatatttaagcggctgcacctgggcaccgtgtcctatggcgccgacacgatggatgagatccagagccatgtcagggactcctactcacagatgcagtctcaagcgggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcagtcaaagcacaaaaccgtgggagcttgtccgttccatttggactccagagtcatgaggattcattctttctgggatggggaatatagaggagcagtttatcgtagctttaatgtatgttttagctgtatgtggaaaactgcccaacctattccagcatgtagcctctgacgtagcctgggccttgcacatgcaaatgtgcggccgccacatctcggcacatcccagaacacccagggctggtcacagggaacagcatgagaaataccagcgaggtttactgattccgtaaagtaatttgtgtcaaagctgcattttataaaactgttgaagtttgggactgtccttatggctatggattccgtgtccaaattgaatcatctggtttccatattaaatttccacatattttgccagattttcaatacagggcatttatttcaaaagaaaattggaatgtaaataatttccaaaacctacagaaatggtaagatcttaaacatggtaaattagttatttctaactttacatcactctttgatttttagatcgggaaaattcatta

SEQ ID NO: 90355 - DNA, 796 bp, Homo sapiens
ggaaccctcacccagaatgaaatgatatttaagcggctgcacctgggcaccgtgtcctatggcgccgacacgatggatgagatccagagccatgtcagggactcctactcacagatgcagtctcaagcgggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagaggtcactattccaattcctaaacaggagacgggaagagacacagctgttggatgcataaagaagggtgctagacccacgcctctcctccagcccttcctgccatccctgcagcctccagtccaacgtcaaatacaatcaactggatgaattaaaaagaaattgcaaataataaaaga

SEQ ID NO: 90356 - DNA, 444 bp, Homo sapiens
acctgggcaccgtgtcctatggcgccgacacgatggatgagatccagagccatgtcagggactcctactcacaggtaagtgggttcctcctgcacggggtctgcttccacacacatcccgcgccatgagtccagctgagcctcgtgtgttcccatctgtaaattagcacgcttcttggtggtcttaacatcctgctacttcagtcgtctgttcgaatatacgaatcaggaaatcgtctttgatgagcatttgtacatgagtgaaatcgtagaaggcatagtgtgctgaagtcatttattcatatcacattttactagtgagttatttgtaaaaaattattcagtaaacattgtagttgaagaatgttcagtaggatactacatcaatatgttttctaacagttctgtttttctctataataaaatgttctcatatttttaaagg

SEQ ID NO: 90357 - DNA, 770 bp, Homo sapiens
ggaaccctcacccagaatgaaatgatatttaagcggctgcacctgggcaccgtgtcctatggcgccgacacgatggatgagatccagagccatgtcagggactcctactcacagatgcagtctcaagcgggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggaggagacgggaagagacacagctgttggatgcataaagaagggtgctagacccacgcctctcctccagcccttcctgccatccctgcagcctccagtccaacgtcaaatacaatcaactggatgaattaaaaagaaattgcaaataataaaaga

SEQ ID NO: 90358 - DNA, 1061 bp, Homo sapiens
ggcgtatcggcgcaggcgcactctgccggcaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaagctttaacagttggctgtaatttggcttttattatcctttattaaaatacaaatgtcaatgcttttcctgcctttttaataccatgtcagtgtaacataggtatttattttgctcatccctgtgatctgtgcatttttgctgcgtggatgtgattgtttggtttcagttagaaacgtcatagatttgctgtttgaatatgccaaggtggggacttagacattatgtacgtctcacaaatcctacctgcataccagtcagctctattgaggaagacaatgtaaaactaatgtaaactacagtttgcatttccctgaaaacagaatattgtttttaagagggttagaaacaaccagtgggaaaggcacatgctgctttgtttagtttttccttgttcaaactttgttggtcacattttcccatctgtattcttttttattaagaaaacagcttagggaggctgaggtgggaggattgcttgagcccaggagtccgaggttgctacaaaaacaccattgcactctagcctggacaacagagagaccctgcctca

SEQ ID NO: 90359 - DNA, 607 bp, Homo sapiens
  misc_feature (569)..(569): n is a, c, g, or t
  misc_feature (571)..(571): n is a, c, g, or t
  misc_feature (578)..(578): n is a, c, g, or t
  misc_feature (580)..(581): n is a, c, g, or t
ggcgtatcggcgcaggcgcactctgccggcaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaagctttaacagttggctgtaatttggcttttattatcctttattaaaatacaaatgtccnanaaaaaanannaaaaaaaaaaaaaaaaaacaacacaa

SEQ ID NO: 90360 - DNA, 661 bp, Homo sapiens
  misc_feature (661)..(661): n is a, c, g, or t
cgtcgactacggctgttagaagacgacagaaggggaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaagctttaacagttggctgtaatttggcttttattatcctttattaaaatacaaatgtccatcaaaaatatactttaccaaaatataccgtgtaacttgagggggggccctgtacccaaatttgcctaatgggagtcgatttacaatn

SEQ ID NO: 90361 - DNA, 671 bp, Homo sapiens
ggcgtatcggcgcaggcgcactctgccggcaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttcaatcctcccccaccaactcgaccccctgcccgcaaccacctcggcctatagtcggtccgctcacaactcaactgcccgcccttctacaacgtccccacctgcccgttcgccccatttcctacaggcccgctaccctcgcctttccaatcgtttctatcctgcacgctcctcg

SEQ ID NO: 90362 - DNA, 1066 bp, Homo sapiens
cgtcgactacggctgttagaagacgacagaaggggaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaagctttaacagttggctgtaatttggcttttattatcctttattaaaatacaaatgtcaatgcttttcctgcctttttaataccatgtcagtgtaacataggtatttattttgctcatccctgtgatctgtgcatttttgctgcgtggatgtgattgtttggtttcagttagaaacgtcatagatttgctgtttgaatatgccaaggtggggacttagacattatgtacgtctcacaaatcctacctgcataccagtcagctctattgaggaagacaatgtaaaactaatgtaaactacagtttgcatttccctgaaaacagaatattgtttttaagagggttagaaacaaccagtgggaaaggcacatgctgctttgtttagtttttccttgttcaaactttgttggtcacattttcccatctgtattcttttttattaagaaaacagcttagggaggctgaggtgggaggattgcttgagcccaggagtccgaggttgctacaaaaacaccattgcactctagcctggacaacagagagaccctgcctca

SEQ ID NO: 90363 - DNA, 1394 bp, Homo sapiens
acgctggttttgcatcttcaggagacgctcgtagccctcgcgcttctcctcggccaattcgcggaagaagtggctcacgccttccagagccacatcatcgcggtcgaaatagaagcccagagagaggtaggtgtaggaggcctgcaggtacaaattgaccaggctgttgacggctgcctccacgtcggtggaataattctgacgaatctgggagctcatggttggttggcaagaaggagcctaccacaaaaccgtgctggcaggtcccaaaagcaggagatggccgagaagatggtcccggaggttgcaagcggagaggaaatcggagggcggtcggaggctggaagagagtccccggatctgttccgtccaaacactgttgaagcaagagacagacattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaagctttaacagttggctgtaatttggcttttattatcctttattaaaatacaaatgtcaatgcttttcctgcctttttaataccatgtcagtgtaacataggtatttattttgctcatccctgtgatctgtgcatttttgctgcgtggatgtgattgtttggtttcagttagaaacgtcatagatttgctgtttgaatatgccaaggtggggacttagacattatgtacgtctcacaaatcctacctgcataccagtcagctctattgaggaagacaatgtaaaactaatgtaaactacagtttgcatttccctgaaaacagaatattgtttttaagagggttagaaacaaccagtgggaaaggcacatgctgctttgtttagtttttccttgttcaaactttgttggtcacattttcccatctgtattcttttttattaagaaaacagcttagggaggctgaggtgggaggattgcttgagcccaggagtccgaggttgctacaaaaacaccattgcactctagcctggacaacagagagaccctgcctca

SEQ ID NO: 90364 - DNA, 1048 bp, Homo sapiens
acgagtttggccagacccctccggggtggggcagagaggagggggagttacattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaagctttaacagttggctgtaatttggcttttattatcctttattaaaatacaaatgtcaatgcttttcctgcctttttaataccatgtcagtgtaacataggtatttattttgctcatccctgtgatctgtgcatttttgctgcgtggatgtgattgtttggtttcagttagaaacgtcatagatttgctgtttgaatatgccaaggtggggacttagacattatgtacgtctcacaaatcctacctgcataccagtcagctctattgaggaagacaatgtaaaactaatgtaaactacagtttgcatttccctgaaaacagaatattgtttttaagagggttagaaacaaccagtgggaaaggcacatgctgctttgtttagtttttccttgttcaaactttgttggtcacattttcccatctgtattcttttttattaagaaaacagcttagggaggctgaggtgggaggattgcttgagcccaggagtccgaggttgctacaaaaacaccattgcactctagcctggacaacagagagaccctgcctca

SEQ ID NO: 90365 - DNA, 643 bp, Homo sapiens
  misc_feature (605)..(605): n is a, c, g, or t
  misc_feature (607)..(607): n is a, c, g, or t
  misc_feature (614)..(614): n is a, c, g, or t
  misc_feature (616)..(617): n is a, c, g, or t
ggcgtatcggcgcaggcgcactctgccggcaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaagctttaacagttggctgtaatttggcttttattatcctttattaaaatacaaatgtcaaaaaaaaaaaaaaaaaaaaaaaaaaaaaaaaaaaacnanaaaaaanannaaaaaaaaaaaaaaaaaacaacacaa

SEQ ID NO: 90366 - DNA, 981 bp, Homo sapiens
tctagttgcgtaatacttccttcattggtgaacactaaaaaataaccttcagtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgccacgggaaagactgagggatcatgatcatttgttcagaaaaaaagcccctgaactgattttgttaccatagaatttaaaaaaaaaaaagctttaacagttggctgtaatttggcttttattatcctttattaaaatacaaatgtcaatgcttttcctgcctttttaataccatgtcagtgtaacataggtatttattttgctcatccctgtgatctgtgcatttttgctgcgtggatgtgattgtttggtttcagttagaaacgtcatagatttgctgtttgaatatgccaaggtggggacttagacattatgtacgtctcacaaatcctacctgcataccagtcagctctattgaggaagacaatgtaaaactaatgtaaactacagtttgcatttccctgaaaacagaatattgtttttaagagggttagaaacaaccagtgggaaaggcacatgctgctttgtttagtttttccttgttcaaactttgttggtcacattttcccatctgtattcttttttattaagaaaacagcttagggaggctgaggtgggaggattgcttgagcccaggagtccgaggttgctacaaaaacaccattgcactctagcctggacaacagagagaccctgcctca

SEQ ID NO: 90367 - DNA, 216 bp, Homo sapiens
atgtctacacagtgctccagacaaaggccacgtggtgcaagtggctggggacacttcttaggacacttcttagggatcctagtagagtggctggtatggtggtctgcagctatatggcctggtccttcccacccagagactgcctcctcgtgtaactgagtgctctgatgtggactgcacccacctctgcgtctcatctgcacaccccttcccaaa

SEQ ID NO: 90368 - DNA, 227 bp, Homo sapiens
gaaaattcaacagataaaaacaatgtaattcattttttatggtgtaattttcaaacgttcattataaagttatattattctataaattctcattttgctttcttcaataaaatatttgatgtatacaaatatacaaagtatatatgtaaattataaaagcataatgtaatataaactacatgtacctcgtacccaacttaaaaaattaaacattatctttcactttt

SEQ ID NO: 90369 - DNA, 166 bp, Homo sapiens
acatttgtttaaaatttaattaacttccattatttgaatggcagaaaaagaggcctataccctgacgcatcagtaggaagtacacaccacgtttcatttgcctttgcatatcaatttacatgatgaaagctctgtcctctatattgagctcactacacactagatc

SEQ ID NO: 90370 - DNA, 666 bp, Homo sapiens
caggagaatggcatgaacccgggaggcggagattgcagtgagccgagatcgcgccactgtactccagcctgcgtgacagagcgagactccgtctcagaaaaaaaaaaaaagaacataatatgtgtattgtgtctcatgtacactgttgaagaggtagcagcccatgattgatgaaatagtccagtgatcttatgagatacaagtttgttttcatgttctctctctgacattgtctatgcttagttattgtgttcatgcttattccttcatggtccaagttggctgtcccacctccaggcatcaaaccacattccaaacagcaaccaggaggaaatagtaagctgataggtcatggggaattaggttggaagccattgctttttaatttacagaagtccattctccccaggcacttctttctaagtctcattgatcagaactcaaccacgtggccaccatcagcagaaacatctctctgtagcaccgtgaaacacatgagaacataactggggatgaccgttgttacttgaactattttgaaagatctgacataaaggtcatcgccttgtgcacttcaatgggtgttactgcaaaactcccagggctaggcatggcgacatacacccgaaatctcagctatctgggaggctgaggtgggaggattgc

SEQ ID NO: 90371 - DNA, 582 bp, Homo sapiens
ttttcttcttttctttgccgttctctctgcctcccttatcccccaacccttctctgtgtctttcttctcaggaacaaagaacttgaggaaatccgtgactgtccaaaatcatctgtgttgggaagagttggggagggagaactgggaagcttaaattaaaactcataaaaccaggcagtccaaggagggtagtgttgaaatggttttccctcccctttgattttgtagtaggtttcctgctatacttttgctgatttcttctctggtgcctttctatttttgtttctctccccagtctaactactttttatttcttctgttcttctgtttgaagctctctaagtagctgccttcacctctatggttttaagtttgtgtctgcccagcctcttcctttaactgtgacttggtgtcatcttgttgtgatgggaatgttgccatgggtgcagtgtggtggtgtgttttggttgttgggtggcatgtaagcttggatattttcatagttccagctctttttcttttctaaaaccgtggcatgtgcttctctgataacagccctctactgcagcagtgtactcctca

SEQ ID NO: 90372 - DNA, 258 bp, Homo sapiens
ataaggttagaaaccaccgagctaggatttagacaggaggtgatgacagcaaggacatcagtttcaggaaaaaatattttacccagcatatacactgactatccattgtcatttcctattccttttcattcctctatttactctgacctgcatgttgtcatgcttcctgcttccagctaattattatccttcaaacacactcccctccttggatggttcctattcactatattcctctcagaccccaaatcctattat

SEQ ID NO: 90373 - DNA, 811 bp, Homo sapiens
tgtgtagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtagacatttttatttatataccttgggagctttattacctaatatctttttg

SEQ ID NO: 90374 - DNA, 402 bp, Homo sapiens
aagggtgggactctgatggagcagctggaacacttgattgagaagcaggagataggggttcaagttttggatttgccaccaattagagatgtgactttgggtaactcactgggtctttcttggtcacaatttggaaaatgagaacatcaaactagtctccaaagtcttaagcattttaggtttgcctctggttaaaggaatgctctgtggacagttggatttgaccagttatcaaggtaagattatatctttgggaaccaaagtaaacagttccagatttttcagccagtcttcatcagggtgttatttgtacatcctaacaaatcacagagccgtggagaccttatgatgaataaccataagcctcctggctcttcccttttcttgccatcccagtcctac

SEQ ID NO: 90375 - DNA, 191 bp, Homo sapiens
ggggttccaggtaggggggatggcctagcaaagacatagaggtcagatgcacatccgacattctagaaccctttcaaaggaggctgggccaccaaatgtttatgagtgtatatagctgctggggtttagagaaggccacatttcttggaatcaccttaggagcccagagtctgctcagagagctttccagg

SEQ ID NO: 90376 - DNA, 286 bp, Homo sapiens
aattgaggtcaaaaaattatatttatttatacatagttttttccaaaagttctattctgtgtttaaagggataacatactgcatttttctagttgcaaatgattggttaagtgttcatgtattaatttttctgagagccatcattagctattaaccaatgtgctagacatttttaatgtcattgactatgattactgtactctttgattgctgaaagtgtaaattgataaaactttttatctcagttggacattttttccttttaaactgaaactacaaatacagt

SEQ ID NO: 90377 - DNA, 810 bp, Homo sapiens
ctggaatgtaaggtcctccatgagtccagtgcatatgttttgatttccttctttgtctcctatagcactggtgacagatattgctagctatttgctgtggtagatgatgtgaattactgtacatgcaactcccagtgtcacactctaagacactctataattctgctggtgtatagacagacgtactaatacatttgaacttggaattgaacattatgaaactttggtttaggacactgagtttttttggtagatggaggtgtggtctctttgtctgtagcagtactggcaaagtatcgataatcaagttcatctaactttacaatcttcatttgcctcatctgccagtaatacctgcttcatggaattattacaaaatgtaaataaaataacacagaatttagcaaaagactttccatgtagaaaatatttaataaatgttagataaaaacattatcagtaatgtctattttctctctgtctctgtatattaccaagcaaaggctctagcttaggagagagaattaaagcatctatttgagatatatgtttgagtggatataatgacttatttttgtatttaagacaaaaatgagttgaaagtaaagattttatttatgaaaaaaatccatagaacacctttatgaaaaagaattcaaggatacttttgccatactgaactactggcaagaaaaagatataaaacataaaaaaagatattaaaaaccttataattaacatatatccatgagagtggaaaaaaatcagtattttacatttatatgtaaaatattgcatatatatgtatat

SEQ ID NO: 90378 - DNA, 346 bp, Homo sapiens
ctttgtgggtcagatggtctctgttgcaactgctcgactcagccacagaggcaggagaggctgctgtggacgatttctcaatgagtgggcatggtgggtgccaataaaactttatttacaaaaacacactgtcgctgggcatggtggctcaagcctgtaatcccagcactttgggaggccgaggcaggcggatcatctgaggccaggagttcgagaccagcctgaccaacatggtgaaaccccgtgtctactaaaaatacaaaaaaattagccgggcgcggtggcgggcgtctgtaatcccagctactcgagaggctgaggcaggagaatcgcttgaatccgggag

SEQ ID NO: 90379 - DNA, 792 bp, Homo sapiens
tttcacacccagaaatatcctggtttagaccgtaaatgatatgatcgccctagcttgactccactggtcatcctttaagattaatgttagctactgtttattgagactcttctaagagtcagacactcttctcagctttttgttgcgttgcttcatttaatccccaaaataagactgctaggtgtgtatgcataatctcttcattttcagatgaggcaacagagatgcagaaaggtttgaattattcagtcacacaggtagcaagtggttgatttggtgtgtcgatttgaacctgactattggaatctgtgttcttaagccctccatggggctgcctcactcctcgtttttgagtattgcacccttgacctcatggggccccacttccctgacagtggccctggaatctgttctcagaccacatactggtagaaagttccagccgtgagccaggagtccagccctttatgacaccaatgagaagacgagccgggaagtcactacgtcgttttccagagccagcaacagcaggcctcactgacgtgcgtgtctcctgacttcccgtccggtcccctgccaccactccctaccctgatgttgacaagtgcagcttgttttaaaactgggcgctgcattttacatggaaaagattttattttgaaatctagggtggagtaaaactccagccagtgaagacttgccatgtgctgtgcagagaatccaaacaggccccttcccaacccaaacagccaggagaaactgagtgcagggagtttatttacacatttgttt

SEQ ID NO: 90380 - DNA, 419 bp, Homo sapiens
gattttccacaaactattatttcaaacctagggaagcccaccataatgagaagagcggggccaacacccatgtcactgtggagaagtacagaatatgcaatggaagagttgtttatctgatataagcggtaattggaaactgaaaaattcctgctctggaaaaaagatattctgctcttctgaatctaacagaggaagagacaaacagaaaccatcaattattgtttcaggtatacccagagtaccatctgtaccataaactacaactcaactgttgaaaatcataacttccatcaaaattctaacagctgtgtttcccagtgtcttttatttttttaaagcaggcaagcatcgattttttaaaatttaaaaataacactctttaatattccacactttttcccatttattaactttaa

SEQ ID NO: 90381 - DNA, 227 bp, Homo sapiens
  misc_feature (1)..(2): n is a, c, g, or t
  misc_feature (131)..(131): n is a, c, g, or t
nnaggctgaggcaggagatcctctgaatccaggaggcagaggttgcagtaagccgagatcacgccactgcactccagcctgggcgacagagagagactccatctgtaaataaataaataaagacagcaccngtgcagacagcaagtatgaatgtttatcaaaaatagatttcaattgtactatatgtggaatgaaattttacatattattcagtatatatccattag

SEQ ID NO: 90382 - DNA, 219 bp, Homo sapiens
tctggggctcaagcgattctcgtgcctcagcctcccgagtagctgggattacaagtgtgtgccaccaggcctggctaatttttgtatttttagtagagacagggtttcaccatgttggccatgttttgttttctttttcacagtgttgcaggatctttgtgtacttaagtgtttttagaagatgaagttctagaagtggaattgctagtgcccaagagt

SEQ ID NO: 90383 - DNA, 248 bp, Homo sapiens
tctcgaactcctgacctcaagtgattcgcccgcctcagcctcccacagtgctgggattacaggcatgagccactgcgcccggccaaaaatttaccattggaaccatgtttaagcgcacagttcggtggcattaaacgcatttacgttgttacgcaaccatctccagcactttgtcctcttcccaaactgaaactctgactccatgaaacactcactccctagcccctgacacctctgcatcctacttt

SEQ ID NO: 90384 - DNA, 624 bp, Homo sapiens
caccagctcagcaccgccgtgcgcccagccagccatggggaagatcaccctctacgaggaccggggcttccagggccgccactacgaatgcagcagcgaccaccccaacctgcagccctacttgagccgctgcaactcggcgcgcgtggacagcggctgctggatgctctatgagcagcccaactactcgggcctccagtacttcctgcgccgcggcgactatgccgaccaccagcagtggatgggcctcagcgactcggtccgctcctgccgcctcatcccccactctggctctcacaggatcagactctatgagagggaggactacagaggccagatgatagagttcactgaggactgctcctgtcttcaggaccgcttccgcttcaatgaaatccactccctcaacgtgctggagggctcctgggtcctctacgagctgtccaactaccgaggacggcagtacctgctgatgccaggggactataggcgctaccaggactggggggccacgaatgccagagtgggctctctgaggagagtcatagatttctcctgaaatatgtcctcctttgttgtttcttaatttggaaactaataaaatattttctgtgtgttcctggc

SEQ ID NO: 90385 - DNA, 307 bp, Homo sapiens
cattttccttatgttgagaagacctcagtagaattcatggaggatgtcgaatgcaggaatggggataatatagcaacaagctagtccatgcaggaacatttaaagagttaaaaagacatttgtaaagtaggcagcagctcagaagtaacctcttacagatatcaagaggtgataggagaaagattagctatttaagcaaataattaggacacaattaaggccaatttggcctcttgctgagggtaaattaaactctaacagaaacaggctaattaccctcaggaaagagggctaaaggatcctttac

SEQ ID NO: 90386 - DNA, 326 bp, Homo sapiens
gtggttgtaatatcattatttggcattgaaattcaggaagaggaaatactcagtaaatgctttctgactaataaataaggtcataaacgggtttgcttttttgatataattctatgattaatatttatgatataatctttaagaatatcaaattaatgtaagattttagattttcagttaaattgtgtatttagttaagtacaaatgaaatatattaattactattgtgtatgctatgctatggagggttttagaattatttagacaactttttccttcagaaaccaaatattctaaatttctatattgatgcacacatgaaataa

SEQ ID NO: 90387 - DNA, 214 bp, Homo sapiens
tttttttttttagaccgtttcagacctgaaaaaactaaagaaccagagctttactatttgtagaaggccttaaaaggagatagaatggaaaaaattgtaaaataagtattgcaacatgtaattaacaatattgttatctgtaccaacgataaaaccgtggtacggaatgctactgggagttaaattgctgtttaatagcacaaaacctttaaat

SEQ ID NO: 90388 - DNA, 459 bp, Homo sapiens
tttgtcttacctttcctgatgtctgtattcctcataactgatactacctaaggaagcctctgctatttgaaacccagtatatcctgagcctgacagaacttatcctgtctcatgcactcacttccaaagactctcaaattgaggtgagcactcccagccagccttcaattcagtacctctgtcttctgacacatacaacctaccatcattgaaccagaaagaaacagaaaatctaaacagaccaataatgagtaacaagatcaaaatagtagtaaaaaatctcccatcaaagaaaagctcaggacctgatggattcactactgaattctgctaaacatttaaagaactaataccaagtctactcaaactatttcaaaaaactgaaggggggaatacttccaaattcatctatgaggctagcattaccctgataacaaaaccagacaaggtagagccgag

SEQ ID NO: 90389 - DNA, 521 bp, Homo sapiens
tgggggacattgcagcacattgtgggaagctgaagggtggaacttcattatgaacacaagttgtcttaatatgtagataaagtcttttaggtaatctcttggaactgccctcagaagaataaaagcctgtctgggtgtggttatgacttttagtcttttctttggtgactaatctttcctggttatttgatgagattcctggggaaggagttttaagacaattgcatttctaggccaggcacagtggctcacgcctgtaatcccagcactttgggaggccaagggaggcagatcatgaggtcaggagttccagactagcctggccaacatggtgaaaccccgtctctactaaaaatacaaaaattagctgggcgtggtggcacacggctgtaatcccagctactcaggaggctgcggcaggagactcacatgaacccgggaggcggaggttgcagtgagctgagactgtgccactgcaccactcctacctgggcaacaggagcgaaactccgtctcaaaaa

SEQ ID NO: 90390 - DNA, 241 bp, Homo sapiens
  misc_feature (38)..(38): n is a, c, g, or t
cacaaaagtgggttatcctggcagcacagtgtacctcntagttgttctctgatgtgtaaaacttggtgtaacacatctgagtgtgtgtgttggtgttttattccagtagttaaaatagacataagacaaattcatataaaatgtttgtagactgcaatgtcttctgaagaatgctgtcagaaaatcattattctaggtccccaggtttacatccctctgtgagacgctcttgtaccagttg

SEQ ID NO: 90391 - DNA, 260 bp, Homo sapiens
ccagggtacatcgtttctcgggatccaaacctacctgccaaacagactatcctctccccactgtcaccccaaatcaacacacagacagaaacacctgacccttttgaaaagcatagaaagcaggacacacactgggatcctgaacaaatgcccagctccatgtagggtggcctgatttgggttcaaaggcgagaaagcacacggggtttccttgctcccccactagatttaagtagggttttaaagcactcttctctggc

SEQ ID NO: 90392 - DNA, 1106 bp, Homo sapiens
ccgccaagcatattgctaggcacagaacaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctcctccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccaggaaatctggggctccatgtggcagatctccccagtgaccctccagcgcaggtgcttcaagacaggaagtctaagcagccaccgtttcggtgtatatgctcattatcctaattatgcagcagcaacagcgcctaagagtatcttttcaaatttcaactgaagtcacatgaagacccagatactaacatatggtgataaatgttataaggaaaaataaaggtaat

SEQ ID NO: 90393 - DNA, 1110 bp, Homo sapiens
ccgccaagcatattgctaggcacagaacaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctcctccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaaggtaagaccctgtgggtggg

SEQ ID NO: 90394 - DNA, 402 bp, Homo sapiens
agttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcggtaagtggccgcccggcgtggcattaggagagcgggacccggtccccggagggcgccgacctcgcggtgccggaggagggcgcgcggtctccgggcgcgtggcgcgggtgcagcccggcaagggcccttctgtcctggctgccctcg

SEQ ID NO: 90395 - DNA, 364 bp, Homo sapiens
tgctagtacaaatgtctcagagaactttcccttccagcacatgcaggtcttccttaatatttctgtgggttgtagtatagtattccagtgtattgatgcatgataatttatttaactgctccccattgataaacatttaggttgtttctagcttttattttttctattagaaacttgtgtctacattgtatggaaaactgtggcaaacatccgttggctgactccattaactctctacctttccgcacacattccacaaataaatctctgaccttttccctatcttggctctcttaaggcaagcttgggttcatatgtggtcctataccacatgagatattctgatctatagctgcattcagcc

SEQ ID NO: 90396 - DNA, 461 bp, Homo sapiens
gatcgcttgagaccaggctggccaacatggcaaaaaccccgtctttacaaaaaatacaaaaatgagttggttgcagtggcgtgcatctgtagtcccagctactaggggggctgaggtgggagaatcgtttcagcacggaaggttgaggctgcagtgagccatgattgtggcactgcgttccaacctaggcaacagagtgagactctgtctcaaataaatagttaaataaaaataaaaaaatatatattaaaatatatatatgtatattttaatagcgagggtttaaaccaaaagttttggttttagctttagttaaccagaaatgttccttgaaatccctgaaaaatgttactgtttcttattactgttttgacctcatcttttaccactattttttcaaccactctgccccattatagtggttttatatagcttttaatataccaaactgtcaggcgggt

SEQ ID NO: 90397 - DNA, 442 bp, Homo sapiens
gagttttgacatttttttcacagtaagctgaccaatttccttgaactttatctgttggaatttcttgaagctttatgacttccttcatttgaattcatttcttctagtcttctaggggctctacccatctggcatcactttttaaatttaaaatttatccactgggcgcagtggctcacgcctgtaatcccagcactttgggaggccgaggcaggaggatcacctgaggtcaggagtttgagaccagcctggtcaacatggtgaaaccccatgtctactacaaatacaaaaagtagctgggcctggtggtgcatgcctgtaatcccagctactcaggaggctagggcaggaggatcgcttgagcctgggaggcagaggttgtagtgagctgagatcgtgccattgcactccagcctgggcaacaagaacgaaactccgtcta

SEQ ID NO: 90398 - DNA, 370 bp, Homo sapiens
atttcatttaaacttttattaacaaagtattcattcaggtatcacttggtttggccaaattctgtactatttgttttgtagacagtgatttgaagtctaggatgatattatttccagaggtatttacagttgttaaaattatttcactagactgtttttaaagttttaaaattggattgatttgttttaaagttgtcttcttaaagtagtattttggagaattattgtggaattatcatttgtttttaatgcatttttttctacttagtatttttattgtatatatttagagtgtaaaatatgatgttttgatatgcatagtgaaatgcttagtacaatgcattttctttatttaaatagtgagttaatt

SEQ ID NO: 90399 - DNA, 494 bp, Homo sapiens
acagcaggacttttaggttttacctaggttcacacatcccatttaaatcaatttgtttttccccatattagaatagctcactgcaactaatgctggccccacggttgcctacacagtcggctttccctggtgcactggacaccaacagaaattaagaatctcaactgcatacaggagatgtgctttttaacagccaggtagttgtgtgtgtggccttcacaatttcagagcctttctgccatccgaaccagcaagcaatctgattcagcaccacggacagtgccatgctcacctccccctccaagaactctccaaaaccccaacgcttagattacatcataaacctctccaataattcctgaataaaatggtactccccaccacccaagcatctcaaaacattcaaaataccaagaaacaggtattaccactcagacgtttaagacattaaagatcaatttcagtcttgatagtctcttaatacacttaattaa

SEQ ID NO: 90400 - DNA, 448 bp, Homo sapiens
atcagtatatgcgaatttagtgcatgataaaagtaatatatcagcggacaaaagagaaattcttcaaatcatgagttataggcaaccaattaactatttggaagaaacctcaaatgaatcaaaattttaaatataggaactataaagatagctgagaggaattatttttaagcaaactaccaaagacagaaacaatcataaaaggaaaacaaaagatttcaacatacacagctttaaaacatccatatgacaaaatacttcattaataaatgggacatttggggatttagttttaatttgaatttttgaaaatatataacaaaggggccttataaatctatattaaagaggccacccatggtggctcacacctgtaatcccagcactttgacaggccgaggtgggcggattgcctgagctcaggagatcgagaccagcttgagcaaca

SEQ ID NO: 90401 - DNA, 287 bp, Homo sapiens
ctaggaggtagggagagaatttactaagtaaggagagaaaggaaaaagaacaaacatggaatatgatcaagcaaataacttccaacagaaacaagaagatatgttttaaaatatatttcccctgcccaatagtaaaacttatttcaggcacaatgcattactgaggtgaaattaaagttacataaaattgaaaacatcacactggaaaacatttcatgggtctcaactgaaggtggcatagtccaggaaggcatttggacatgtatgggttgttttctggttgcccc

SEQ ID NO: 90402 - DNA, 480 bp, Homo sapiens
  misc_feature (2)..(2): n is a, c, g, or t
  misc_feature (235)..(235): n is a, c, g, or t
  misc_feature (343)..(343): n is a, c, g, or t
  misc_feature (347)..(347): n is a, c, g, or t
  misc_feature (354)..(354): n is a, c, g, or t
  misc_feature (364)..(364): n is a, c, g, or t
  misc_feature (373)..(373): n is a, c, g, or t
  misc_feature (375)..(375): n is a, c, g, or t
  misc_feature (425)..(425): n is a, c, g, or t
  misc_feature (428)..(428): n is a, c, g, or t
  misc_feature (441)..(441): n is a, c, g, or t
  misc_feature (452)..(452): n is a, c, g, or t
  misc_feature (470)..(470): n is a, c, g, or t
tncgttagacattgaagctataacaaaataaggcccaggtatcgctcctgaagagtagcattctatttgggaaaaaagccttgaaagcaaatcattaacagcgatttcccattttgctatatgtttgtgttggtttttcttgaatcttttacattgaaaacacattcacctattccttcagttataaaaaaattaaaaatcaaacaaactcttaaaggattccgtgggctttaanagatgtgtctgaaggatggaaagaaaagtattaagtcagcagcagagaaaaagcaattaattcgggggggtgggaggagcagtcccacaaaagcttcaaagaataaangacntttaggntggttcttgnaagacagcngnacaaattttgccaagtatagtatgctaagcttcaaggccagtgtcaaagnagncaaataattgggncctaaaggttntaagattcagtaagttanattgttatgg

SEQ ID NO: 90403 - DNA, 489 bp, Homo sapiens
agatgaatttttaattgtcagcaacaatctaattagtcctgaccagagcctgttctttctttcagcctatttgcttttgccttcagggttagtagctggcaactaatatccactagaactgaatcacccgaattatcatagggctgagctaatatcctgctgtagatgctatcataggcagaaagaaaattgaaaggcaagttctaccatggcctggctgtaagcagccactgttaggtccagactccatgctttaaagttagcctcaagattcctggaaatttttacttaggctaaactagggaccccccaaaaggtgtcccagttatttttagtatccctttgttgcaagatagtataggatatggggcaaaactagatctcatgctttcagtagttaataaccttaacagttgtcatttatttaaggcctgtgctgaatgctttatatagtttttctcatttattccccaaaacaattattgtaaa

SEQ ID NO: 90404 - DNA, 392 bp, Homo sapiens
gttgaagttccccagccagttaaagggcacaccgtgggggcagcatatctccatgggtctatctctagcaaacagaatcccagaaacttgagcacctgatatagcagaaggaaataaagattatagtaagtatattcatgagagagaattttttttgcctccagatgtttggggtttggatatgtagggtaaatataaatgtctaatgaaagtaattactattatatttgatttgatatttaatttattatactgaaatactaaattaaatacaaaaaaactcctacatactaactatatgtttctcccactgattcccctcctgcctccttcactgattttgaatgtgtgctcaatttgctagtatgagatttacctctgccttatcagtg

SEQ ID NO: 90405 - DNA, 441 bp, Homo sapiens
tcctgcctcagcctctcgagtagctaggactgccggtgaccaccaccatgcccagctaattttgtaaaaagcttttttagaaatggggttctcaccatgttgcccaggctggtctcgaacttcttgcctcaagcgaacctcctggctcagcctctatcaggtttcataattttactttagccttcgcaatggaatttaaattgtgccagccatcttttatctgtcagacccaggggatttttattgtcattttgaaccagatctatttttgcttaattctatgggaaccacacatagtttgtacatttgccagaaatttgttttccagtgaatattactcaattctaagtaagtacattccgcattttcatactgggacatagtaggggtgagttcaattaggaacatccatttttaaattatatgatgtagcctgaactt

SEQ ID NO: 90406 - DNA, 491 bp, Homo sapiens
tatactagcttagtattattgggagaatgtaatgattttctgtatttcaaaagtgtaaaatacaaagtgggccatggcatgagataaaccagtgaatatgttctgggaacaggtcatagaagggcgtgtatgctgtcctaaggagcttaaacttcaacttcagttcatgggagccaatgacaagatctgagcaggggaaggttgtggctagaggggcattttagacagacaagatcctctgtggattacacctaggctaagcaacgggttaaagttgttgtcttaagacgatggtccaggtaaaagataataaagttttaaattaggatgttagtaggaatgaggaagagggatggatttcagaaatagtaaggaaatgtattagcaggacttgattagtgattgacttggggaaggaggggaagatagagttcaggatgactccgagactgtctggtgtcggtggctaatgactgaagctattaatagag

SEQ ID NO: 90407 - DNA, 302 bp, Homo sapiens
tattagagacggggtttctctgtgttggtcagaatggtctcgaactcccaacctcaagtgatccgcccacctcggcctcccaaagtgctgggattataggagtgaaccaccttgcctggcctggtgtaatagtatttgaagaaggagtgtagcagtttcaagaagcacattgttagtcctagagaaaccatcaaaacaatggcaaggagtatagctaataatggtggaagtaatacagaactctaaaaaaacagtcaattcaagaaaaggcaagaaaaaaaaagaagaaacaaagactagat

SEQ ID NO: 90408 - DNA, 450 bp, Homo sapiens
taggatgggaatggaaaacagtgctggagactggggaagtggctatttcctgtgtctcactggggaattgcaagatcaaagaatgttgttacttttatgtgatgaaaaaatagggcaagaaagatatacctgaatcatcagactgcttaaaatttgggaggaaaaaattctattttactactaaccataaatcacttttgctagatagtactttaaagattctgaattaaatgtatctttaaaaacaacaatataatattactaaaaaatgcagacatacttaaacttgctagaataaattctgtgaggtcttcgtttggtattttcataggatttcttactgttaagttattggaaaatgaaaatataaagtgctttcagaagttatagtattttccaattcattgaattactttgcttgtgaaaatatattaaacatatttaaatgag

SEQ ID NO: 90409 - DNA, 197 bp, Homo sapiens
ggcctcctttcctgagagtctccttgctgccctggcctccatcaaggtatgccaacatggacctactggggcaggaggctggtaatggggtgtctcttgtggtgctacattaggggtcacattgcagctccccatctgttgatcattccctggccttggtctctgtgttccttgctgcaaagccagagctgaggaca

SEQ ID NO: 90410 - DNA, 295 bp, Homo sapiens
taagacttcctgttagtaaaagctacctcatgaaaagtattgatgttatttgccaacatttagactagcttttgttaccgtttcagttattcaatttagtcagcacatgtttgagtgtcttactgcaggtgaataatccatgatttctgccccagagtagttcataagactggtaggatacatagatttgtaaataaataattataattctgggcagtaagtgctgctatagaagtctctataaagcaatgtgcaaacacaagaaaaggagccgttaattccttatagggaaagg

SEQ ID NO: 90411 - DNA, 274 bp, Homo sapiens
attgcccctacatctgtaacccaggccacactactgctcaggttgaacccagggtcattccagctgctcgtacccgttctccgtgagccgggacattcctgtgccacaggcattaccttggcagtgcctctctttaggaggcagcacttgaattccccatgtgccttttcatggattatcgccttaattcccaccatagcccagtgaagtaggttcacatgtccccattttatagatgagaacacatgctcagagaggtaaggcaactcaccca

SEQ ID NO: 90412 - DNA, 132 bp, Homo sapiens
tgagcacatgctgttgggaaaacaacgccaatagatttactcaactcagggttcccacaaaccttccatttgtaaaacatgccatatctgcaaagcacagtaaaatgaggtatgtcgatactttagccctta

SEQ ID NO: 90413 - DNA, 444 bp, Homo sapiens
atttactcttggaaaaccataaactaagacatatgtcataaaaacaatgtatagatttcatgggaaatctatcgagtttagattatatagcacaggtgttaggggctatggaaagtctgcaggggttaattaggaatcctaatttctctatctccagagtcagctctaactacctcaaagaataaaacttatttttcagttagagctataaaatgggaggcaaattttgtctttaaataggtaccatatacatggctgtgtcaaagaatgtactgtatgtaatggtgactagaaaagctgaatgatgtatgacctttaagaaattaaaaataaatgtagaaaatcaggcacgtttatgttccaaaatatttgtgtattttaagataaagctaggtctaaagctgttaggaaatgtttagtgcttaagctttattcttacccagc

SEQ ID NO: 90414 - DNA, 449 bp, Homo sapiens
aatctgcagccgcacacctccaaaaaggtacctcttataaaaagtaagtctgaaacaccatagcatgacagccacaaagcacagcctgtgttcaaaatgcaaagcaggaaagctgctggtgccttcactgtcaaagcgggaagaggtccagatttcttctgccccttttttccttcactatgccccaaaaaggtgaaaattaagggagagaatcttagcatgcaaaccctgcaccaccttctggggattgtcactgatggtgtgtttctgttcggtgggaagagttctttccaaggtgcagatgcccataggcagccatttacgttctcagcctttgaatcctaaacctttcactcacaaggtgagggagagtgacttcaggaagaagaaaattcagagttgtgccacccggaccactgtcaatggaattgcagcctattacatgtcag

SEQ ID NO: 90415 - DNA, 349 bp, Homo sapiens
agtagtagagcactgaatgctcaactgaacctaagcagaaatgtgcatggacataacaaaatacaattcgcccctacatacagaaaaggcaacatggtacagagcatgaaagaggtaggtcactcttctatgcattgtctcagaactgggttcctcttcccagatcccttgcttcctataccccagccacacttgtccaaattcatccctactccagagctttggcacaatttgtcccctctgtctgaaatgttctttccccgtatcttagtaagacgggtcccttctggccattcagatttctgcttaaatgtcatcttatcaatcacatcaatgatcacgcatccga

SEQ ID NO: 90416 - DNA, 350 bp, Homo sapiens
taatcccagcactttgggaggctgaggtgggaagttcttgagctcaggagttcaagacccgcctgggcaacatagggagaccccgtctccacaaaaaatataaaaaattagctgggcatggtggctcacatttgtagtcccagctacttggtaggctgaggtggaaggatcacttgaacccagaaggcggaagttgcagtgagccatgattgtcgccactgcactgcagcctgggtgacagagcgagactgtcccaaataataataataataatgtctggaataatccactttgcatttgtgtagctttttcagtgtttttaggtttatcatctcatcttgtattcagca

SEQ ID NO: 90417 - DNA, 865 bp, Homo sapiens
tgttccctgctggtgcaggatattatgagagttccagaaggaagcagggcataaactgcctggggctgagcagacgcacctgtggtctctatcaccccctggagttctgacctctaagtgaaaagaaaaggaggcagaggtggagaccagacccaacagctccttccaaacaatggttctgcctgtctccttgggctccccaatttcccaggaagcctttcctgcgtgggggggcaactaccctcaggtctctgctctgtggttaactattttcctccattcatccatcatttagtcacttatttaataatcattggtccctactacgtgccgagcatttgctagattctaaagatacagagaaaaccccactactgtcagagcaaacaataagaccaatgtacacaaataatttacagtaatgttcctgtatataaagtgccaaaaagaaaacctgtgtgtgccacaggtttagcctggggcatggaaaaggatatgattacttgtcctctggaagccctcagaacaagggggtctgatttctcccaaagagacaaggtgtcaatggatcttcccagcagagagaagcgcacgcacaagaaccctggatggagaaggagcaatggaaacagaagtgagagaactgattgaaagagaggcattgttatagctgggtagcaggcaatcgacatgagctcatctgagcgtaggaataatcgtgctaccatttctatgaggttgttgagaatattaaatgagttatctaacccttagcacagtacgtagcacaaggtaatcacaatgttaaccactactactcattaaagcattgcatgagaataaaaaattagttacatagatggat

SEQ ID NO: 90418 - DNA, 480 bp, Homo sapiens
tggtgtctccttcatagggtgtttgtaaataaatgaaataatgagtatgaaagctattacccaatgcctggcacacagtgaatgtttgataactggaaagaacactaatttttagattgaatggatcccatttagaaaaacaaaatattttagagttgcattttttaatgaaaagaaaaaagtgggggccgggcacggtggctcacgcctgtaatcccagcactttgggaaactgaggcgggcggatcacctgaggtcgggagtttgagaccagcctgaccaacatggagaaactctgtctcgactaaaaacacaaaattagccaggtgtggtggtgcatgcctgtaatcactgctactcgggaggctgaggcaggagaatcgcttgaacccaggaggcggaagttgcagtgagccgagatcgtgccattgcactccagcctgggcaacaagagcaacacgctgtctcaaaaaaaaaaaa

SEQ ID NO: 90419 - DNA, 586 bp, Homo sapiens
ttcagctagccaaaaatggtattttcatttgctgaaattctaaacaaaataattaaagttaaagcacagatgatgatgctaccttatttttctacatgtgggaaagcttgattgatagtaatgattagcgcctgcatctcacaatcactgagaaatgaatgcagcactgagctctgtttgccctctaagcttgtccccagaaaaaacaagatataccctaaatagtaagttataatatttttattagggaacattattagagtttttttttaatatatctcgtagccatgtcatattaatcttttttcttttttcctttttttcatttttctcttttctcttctcttctcttctcttttctctttctcactctgtcacccaagctggagtgcagtggcatgaccatggctcactgcagccttgacctcccagactcaagcaatcctcccactccagcctcccaactgcttgggaggctgaggcaggagaatggcgtaaacccgggaggcagagcttgcagtgagatgagatcgcgccagtacactccagcctgggtgacagagcaagactctgtctcaaaaaaaaa

SEQ ID NO: 90420 - DNA, 450 bp, Homo sapiens
taaaatacaaaaacaatatgctgcgtcgacgggaaaggcagattcttctcctgtctttttttaaatgattgcttgatttggtttccttaatatcaatatttcccaaagcagtagaccactttgtaacattaatcttcccctaaatattttttctatgctcgctgggtacggtggctcgcgcctataatcccagcactttgggaggccgagacgggcggatcacaaggtcaggagattgagaccatcctggctaacacggtgaaaccccgtctctactaaaaatacagaaaaattagctggacgtggtggcgggcgcctgtagtcccagctgcttgggaggctgaggcaggagaatggcgtaaacccgggaggcagagcttgcagtgagatgagatcgcgccagtacactccagcctgggtgacagagcaagactctgtctcaaaaaaaaa

SEQ ID NO: 90421 - DNA, 667 bp, Homo sapiens
tgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtggggaaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgttttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattt

SEQ ID NO: 90422 - DNA, 175 bp, Homo sapiens
gggaagctgttgtcttaaatggaaaaaccaagaaaccagaaatgataggcccaggttctagctctccatcagtcaaacatgaactttactctcgccttctgcagaagatgagtcagtattcctacttcaggagttgtaaaaattaagcacatctcaagcctggtaataagtttct

SEQ ID NO: 90423 - DNA, 178 bp, Homo sapiens
aaatgttcccatagcagaagaatcagccccacagtgcaggggtgtgttagtggggaacgggctctgggctcctgtgggaaccagggaccccctatcttggtaccggtcattggatgtatccccagctcatgcctgtgtctgtcttggcccgtgtggtcaccctgtgttcatctctctc

SEQ ID NO: 90424 - DNA, 324 bp, Homo sapiens
ctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattga

SEQ ID NO: 90425 - DNA, 424 bp, Homo sapiens
gttcagggaggtagtgacacagatgatgctgaagtctgattctggatgtattgcgaaagggaaagcccccaggatgagctgatcatcaaaagtgaggaatgggagaaagaagcaatcaccgcggatgattctgaggattttaccccttccacctctcaattcctgaagacccatcccttccttttaaaatccaactctggccgggcatgctggctcacgcctgtaatcccagcactttggaaggccaagacgggcagatcacgaggtcaagagatcgagaccatcctggccaatgtggtgaaaccccatctttaccaaaaatacaaaaattagccgggcgcggtggtgcacacctgtagtcccagctactcaggaggctggggcaggagaatcactagaagctgggaggcagaggttgcagtag

SEQ ID NO: 90426 - DNA, 653 bp, Homo sapiens
  misc_feature (1)..(1): n is a, c, g, or t
  misc_feature (25)..(25): n is a, c, g, or t
  misc_feature (377)..(377): n is a, c, g, or t
  misc_feature (438)..(438): n is a, c, g, or t
  misc_feature (459)..(459): n is a, c, g, or t
  misc_feature (641)..(641): n is a, c, g, or t
naatccccacaactgtccaacagantctatttcatactgattctacaggtaagaaaaataaaatttaggaggttaggtagttgataaatggaggagttggtaatttgatctaaattggtctggattcaaagcccattcttcctttatatcaaagtttatcccatcaccatatagaaatggaaattctcttctaattcttaaataggttatagttaccatgggagtattctcccccttgctctgactcaagccacatgctgaagatgatgtgttacgaataaggctgagaccaggagactgggcttctgggctcagctctgtttctaactagcaagtttgcacactgtctctgtggtctcccctttgtccctgtggcnttttcggcttttcttgtttgggctttttggctcctttttattagtatctactgtatgctcngcacttgataggttatctctngtacttaaactaggatacagattgtctccaatttagaagtgaaaaagctgaggcctggagatttcaagcaacatgcctaatacctctcagtccacaaaatggcaaagctgagatttcgcctgaagtgtgtctgactctaaagctcatgttcttgccatcttaccagctgcctcatcctcatntatagcctcatg

SEQ ID NO: 90427 - DNA, 421 bp, Homo sapiens
gaaggccaggcacccacgaggcggcctcgggttcccacctgtgtcacacagcccgggaaccacgtgcaaagcgatcccaagcggtcgctgaccctctctggtcatgagttgagggccatacagatccagtttcattcggaacagcacatggaccctctgtttctccctctgggagcacacagggagatggacacttgcaccctgcccttcacactctgcagccatgaggccaggaagcacttgaagggtgctctgtcatctgaacagaaaccccacactctttggtttttccatttctctccacagtagcttccacatcagcacagcccttccccaccccctcacccccacactccccaccccctcccagattctaagatctgaagcagaacatttctctggttattatcttcaaagctcc

SEQ ID NO: 90428 - DNA, 585 bp, Homo sapiens
taagattgtgctatagaaactacatggtcacctccatttctaaattgttagaatgctgtcaacctgtaaacatcatggcattaagagagcatttgcctaactgtgaaagggttgtatggaaaaataataatatattgcatcaatagttagaaagttttaacttttagaaaatgattttatgaaattagcctgtgtaacttcataaatagatgagttaatgaaattctaaacatgtgaatgtttgctaaaaataaaaatattttatcccctttccactttaggaaaaaatatattaaatataaaaacaaactcacatgtatcaatatttttttaaatcattaaccatccttctttcataggtttaaaatctttattgaagggatcactgtaatgttttacacacaacgtttggctgatagtaactggcaattggatttagaatcccaattcaagcacaaatccctggatgtcacaggggaaccttgatccttgatctaaggcaaataagttcttctccaagttttataaaagaggatcacttatagccaaccatgacgttataactctcatggcatggtgcttagt

SEQ ID NO: 90429 - DNA, 151 bp, Homo sapiens
atggaggagaatttgtcatctaagtttcaattactattatttaaatttaaaatttttgaacaactagtacattcatatggtccaaaatttcaaccatataaaaacataaaatatttattgccagtattgttctattgttcttttttttttc

SEQ ID NO: 90430 - DNA, 299 bp, Homo sapiens
gggttttgccacgttggccaggctggtctcgaactcctgactttaggtgattcacccacttcagcctcccagagtgccgggattacagtcgtgcgccagtgcacccagccttgaatccttctgatagaggaatattttccaaattaagtaaaaagagctttactggaggtactagttcttctcaaatttcagtttgcataagaactgccttaaaagaatgattagaagtgaagcttggaagaatgctgactgctggactttatttcccaaatggataaggtggggaccgggaatctagg

SEQ ID NO: 90431 - DNA, 496 bp, Homo sapiens
ggtggtggaagggtggggtgtagtgggagtggggagtcgcctgctgcagaggcacagcctcatggacaacctgtgttagggcagtgcacctgtggctttgcaggttttagcccccgcggctgctctcagggactgggctgctgttgagtgcctgtagcttttccacagtgggggtgcaagctgttggtgggtctatgaatctggctctgcctctgcagcaggcttctgcctggaaacagtgggaggtggaggtgggggttgcgggggcagatccttcaccagtggttaagcaccatcttcttgatgctgaccttgtgatactgagttctcatgagatctggttgtataacagggtgggcacctctttcctctctcagtcttgcttctactgctgccacatgaagcatttccttgccccttggccttctggtatgattgggaggcttcctgagtcctcccggaagcagaagccactatgcttcctttacagcctgca

SEQ ID NO: 90432 - DNA, 731 bp, Homo sapiens
aaatattcctactagtttacagcttcagtgcttcccccagtgagcagatctcagctgcgattctccacatttctggattttgccctataacctcagtttcactgatgggccaagaaaagtctccaattttcagtttgtttagtttttttgttattgtaaggacaggagtgatgacttcaaagatctttacaagccagagttaaaactggaaattcaaccacagctttccttattcactaagactgcttctcctaggccacagaatcaagaggcttggttttctttcttttttttttcctggtttttatttttattttttatttttttgagatgaagcctcactctgttacccaggctctgttacccagaagtccagtggctcaatcttggctcactgcaacctccacctcctgggcatcaagcgattctactgcctcagcctccagagtagctgggagtacaggtgtgcaccaccatacctggctaatttttgtacttttagtagagacatggtttcaccatgttggccagactggtctggaactcctgacctcaggtgatccacccacctcagactcccaaagtgctgggattacaggcatgagccaccgcgcccggctactggttttcaaatgtggctcacatcacggcataccctgccacgcatttaacctgaaaactcccctttcagtaattaaatacatttgcttcacgggtcattatgatgtgat

SEQ ID NO: 90433 - DNA, 496 bp, Homo sapiens
aaaacaaaaaacgggtcctttgaaaagataaataaaactgataaaccatcagcaagattaaccaagaaaagaagacagaaaatccaaataacctcactgagaaatgaaagaggagacactacaactgacaccactgaaatacaaaagatcattcaaggctgctatgaacatctttatgtaaataaactagaaaacttagaagagatgaatatattcatggaaaaatacagctctcctaggttaaatcaggacaaattagataccctgagcagaccaacaacaagcagtgagattgaaatagtaattgaaaaattaccaacaaaaataaaatacaggactagacagattcacagcagaattctaccagacattctaagaagaattggtaccaatccctttgacactaattcacaagacagagaaagaaggaatcctccctaattcattctatgaagccagcatcatgctaataccaaaaccaggaaagaacataacc

SEQ ID NO: 90434 - DNA, 326 bp, Homo sapiens
tgtccatactttagcacatacaaggagaatcttgggagaaattaagggtgtgacccaggaactttctcattttgaatcctcttcctctgccctcctttgattcagttttcaagtgagtgctttgagcctcagagtgtggaagttttcaatcaccccctgaacattaagcctgtatatataaatttgcagagatgaagtaaaataatcaatataaagtgcttatcacataactacacttccaaaagtgttagttttactgttattatgatcatcaccatttcgatttcagtctgccctctccttttaacataacaccatatacagca

SEQ ID NO: 90435 - DNA, 216 bp, Homo sapiens
gccagcctgggtggtggggccactatgcttcctctggtgattctctctaagagaaagagcaagcatgacctttcatcacatcttctcttggatgcattcaagatacagccaccagcagagccccaggtactttggcaggaggtgaaaaatgtcttacaacttccggaaacggcagtccagatcagatcactgtgtgactggctaaccgtgtagtgg

SEQ ID NO: 90436 - DNA, 450 bp, Homo sapiens
gtcaggtcttctctgactcctaggacattcctctctctgtctttgggggttgaattccttgttagaactccatcttgttaaaggggcctcgcacctgcccttgccttctgcagcagccctccttaatcctctccaaacttccatctccagaccaccggattctcctcatgagtgccctgggtggacattggtgaaaggtcactgccttcaggacacaccataggtacagtcaccgaggtaacccagttcaaagaagagcaggatgttcagtatttacaaagggatctagcaattggtccaaaccagtcagtgctggcatgcaccgttcatcgtgccatcagtggcaagatggagatctggcaatgcatggctcacagtaagatacacgccctgtgccattccaccctatcattagaaaaggagtcttctttttctttctttctttctttt

SEQ ID NO: 90437 - DNA, 429 bp, Homo sapiens
tgtactttatacctgaacaaattgacaagaagtgggaattacggtcaggccattttacaaactggggcaactgagttcagagagtttgggccactgtcctgaggccaggcagctggaaggtggcagaactcccggatccctgcttccaaccaccgcgctgtgtctccaggacacgtcctgtctcactgggttttctgctcctttccaaatctgaggaccccaaaagaaaaggcctgttttataataacggcttcttttcgaagaggtgtgtgaataatgggggaaacacgactccaaagtactttttctctccagcctgggcaacatggcaaaacaccatctctagaaaaaatacaaaaatcctccaggtgtagtggcacatgcctgtggtcccggctactcgggaggctgacgtgggaggatctcttg

SEQ ID NO: 90438 - DNA, 337 bp, Homo sapiens
tgtagagatggggtctcactatttagcccaggctggtctcaaactgctggcctcaagtgatgctgccaccttggcctcccaaactgctgggattgtgggcataagctcctgcatccagctggttttgtttgtttttttactgcactcaatttcccccagttacgtgcctagcgtaattatcctgaacaattgagaggagagtcagataagataacctttatgcagcatccccctgtagttcgtgattcatctatatggtttaatttgatttttttttttttttaatgagagtctttccaagaagtattgccaaagaataaatctcatcagttggcag

SEQ ID NO: 90439 - DNA, 420 bp, Homo sapiens
cccacacccaccccaaggctgcccagcgctggggatgcactgctccgtttaatccatgcatttaatcccaggatttaaacctagggcttgtgtagttgtcctgctcctagcctttgtccttccggctgttctcctagggtagcccctcctcaattaaagaacattcactgcaagccttctggcaggtcagaagaggagaagccaaagaaacaacgctagtccccatacacccatcacccaacagctcagcactgctagcataacacatttctggtctttgaccaagtatccatgaagcaaacatgggaccttagggaaaggcctcaggcaggctggcccatgagaaacccaaggcagggactactcttggtcaaacagccagccctatgcgtgtgacatgcattactctttttttttttt

SEQ ID NO: 90440 - DNA, 303 bp, Homo sapiens
  misc_feature (179)..(179): n is a, c, g, or t
  misc_feature (203)..(203): n is a, c, g, or t
  misc_feature (253)..(253): n is a, c, g, or t
ttaggggttcaataatgtcagctttttacaagctactctgattctaagggggaaaatgccttccccagcatcattttagcaaagtagaatgtgtgtgtgttgttgttgttgttgttgttgttgtttttgagacacggtctcactctgttgcaatcagtcttagttagcacgtggctttntaagtttaagcagataaggaaatnatgggggaagatgaagaagtctgttaccgagaaaaaaagttactacaganggggaaagggaaagaagtcttgctgggaagcctcttttagcattataaat

SEQ ID NO: 90441 - DNA, 267 bp, Homo sapiens
actggcacaggagcccctgggaactaatgctaactggtcattgtatcctgatgcttttcacagggcctggcagagagcaaactttcacaaggctgcctatgagtacataacttcagagggtgttactcacactggagttgtacagtgtacaacctgggcagctgtatgctgatggcctgaatgcccagtaaatgactggtggaattattcttgatatctcccttccaattcccacacccacttgactctagtctcaaaaatacagta

SEQ ID NO: 90442 - DNA, 401 bp, Homo sapiens
catttgctgtaatctccttgtgatcttttagtttcttgtgcttttaaaaataacaatataatggtctatatgtttatcagtttttacaataatttgtctaaacttcgcttataccagtgtgcatgaagaaccaagtgcagtctgaattagcacaatgcaaatagaaaaccgaccttttattttcctcacaaaattaatataaaccttatgtaaaagaatttttaagtgcttgtaaattaataacaaaatcatacataatgtcagtggaggagaaaagttaaggattttatatcgcagtaaaatgcatttctaaatttacttagtattgttataaaacatattcttgaatattgtatcagagtttatcaccactactgaagtcaaaataaagatgaatctct

SEQ ID NO: 90443 - DNA, 412 bp, Homo sapiens
aactttcttgtaaaactatgataattttgactgatactgtattaatttattttccttccttccttccttccttccttccttccttccttccttccttcttttccttcttttccttcgagatggagtcttgctctgtcacccacactggagtgcagcagcctgatcttggctcaccacaacctctgcctcccgggtccaagccattctcctgcctacccagtagctaggattacaggcacccagtaccacgcctggctaattttttatttttagtagagatggggttttaccatgttggccaggctggtcttgaacttctgacctcaagtgatccacctgcctccgcctcccaaagtgtttgggattacaggcttgagccaccatgcctggcctacactgtgttaattttctt

SEQ ID NO: 90444 - DNA, 321 bp, Homo sapiens
tcagatatacccagaaggactgaatgagaaagtgggaacttgctatatggcagtatttcaagaaatggcttatctgggtaaactaacagtaaaatactcgtgtctattatcaaatcaaatctaatgagtgaactcttagtggggtttggaactgcctgagaatattcctatagaaactgggtcatcttgccttctgtgccactagaacctactgtctctccaatagctgcttctctctaattcttcaccatagttttgtttctgtggacttttgaggttctctcctcctttgcttttgacttaagttctccactcctgact

SEQ ID NO: 90445 - DNA, 310 bp, Homo sapiens
tggtacaggtgcaatccttgccccacttcctgggccgagtctggggctagaggagggatgtctgagaccagacagttatctcgggcagagaggaggctccctaaccctcctcactgagcactactgcctgtccccttcccactctaagctgggtctcactgaacccctcaaagacagtgttccatgcttcacacagaaaaaactgaggctcagagaggtcaagtggtagcctgtaacaacttcaccttgaaggagatgaagtttacctaccctggagtaggggcaactggcaggcgacccctgcctgagc

SEQ ID NO: 90446 - DNA, 1262 bp, Homo sapiens
gaagagaaaatcagtgacattccaattcctgaaagagctccaaaacatgtattatttcaacgctttgcaaagattttcattggctgtcttgcagcggttactagtggtatgatgtatgctctctacttatcagcataccatgaacggaaattctggttttccaacaggcaggagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagggcagcatgcaacttggcagctggtctcccttacagtgaatgatccaagagagtatgagagagtgtgccacaatggaagccaggtatctgttataacctcatcttagaaatgatataacatcactctgccatattttgtcagttgcacagacccctggtacagtgtgggaggtgacaacacaggatattaataccaggaggcaggaatcattgggaccgtcttggaggctggctaccacattcaattaactttgctattaatttcatgtaatccctatatctgtcttcatatttgaagaggaaaagatactttctcatgtaaacataatggttttaaagaataagactctcttatgctacttaaacaaaagaataagactctctttagagatcttagtgagaattgtaagaaataaaataaacagaagtctgactgccttatttgatgtcactgatgtatgttgtattgctggagtagaagttaaatagaaaaattgacctggtatattctactcaaatgtatcttttgacaattgaaatgttcttaatagctaagttttaaaaaatgcgtttgtttgctttttgtttatattttattggtatgtatcttgtactgcaaaatacattttaatgccatgaaagaatatgctgtctctttattcatcagctttatagcttttatttatatatgacttcttagaaaagtataaaaagatattaaagtcattccat

SEQ ID NO: 90447 - DNA, 1137 bp, Homo sapiens
gaagagaaaatcagtgacattccaattcctgaaagagctccaaaacgagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagggcagcatgcaacttggcagctggtctcccttacagtgaatgatccaagagagtatgagagagtgtgccacaatggaagccaggtatctgttataacctcatcttagaaatgatataacatcactctgccatattttgtcagttgcacagacccctggtacagtgtgggaggtgacaacacaggatattaataccaggaggcaggaatcattgggaccgtcttggaggctggctaccacattcaattaactttgctattaatttcatgtaatccctatatctgtcttcatatttgaagaggaaaagatactttctcatgtaaacataatggttttaaagaataagactctcttatgctacttaaacaaaagaataagactctctttagagatcttagtgagaattgtaagaaataaaataaacagaagtctgactgccttatttgatgtcactgatgtatgttgtattgctggagtagaagttaaatagaaaaattgacctggtatattctactcaaatgtatcttttgacaattgaaatgttcttaatagctaagttttaaaaaatgcgtttgtttgctttttgtttatattttattggtatgtatcttgtactgcaaaatacattttaatgccatgaaagaatatgctgtctctttattcatcagctttatagcttttatttatatatgacttcttagaaaagtataaaaagatattaaagtcattccat

SEQ ID NO: 90448 - DNA, 326 bp, Homo sapiens
tgctgcataacaaatcacccgaaatttaacagcttaaaacaacaaacatctcacatatttctgtgggtcaggaatcccaagaggtttagattggtggttctagctcagggtctctcatgaggtttcagttatgatgttggcttgtactgtgtcgtctgaaggcctggctgggctgaagcatctgcttccaagctcactcatgtggccatttcccagaggcccagtaccttactggcttttggccagggaggccttaatttcttacatatgggcctctccatagggcagcatgcaacttggcagctggtctcccttacagtgaatga

SEQ ID NO: 90449 - DNA, 1120 bp, Homo sapiens
gaagagaaaatcagtgacattccaattcctgaaagagctccaaaacatgtattatttcaacgctttgcaaagattttcattggctgtcttgcagcggttactagtggtatgatgtatgctctctacttatcagcataccatgaacggaaattctggttttccaacaggcaggagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagttgcacagacccctggtacagtgtgggaggtgacaacacaggatattaataccaggaggcaggaatcattgggaccgtcttggaggctggctaccacattcaattaactttgctattaatttcatgtaatccctatatctgtcttcatatttgaagaggaaaagatactttctcatgtaaacataatggttttaaagaataagactctcttatgctacttaaacaaaagaataagactctctttagagatcttagtgagaattgtaagaaataaaataaacagaagtctgactgccttatttgatgtcactgatgtatgttgtattgctggagtagaagttaaatagaaaaattgacctggtatattctactcaaatgtatcttttgacaattgaaatgttcttaatagctaagttttaaaaaatgcgtttgtttgctttttgtttatattttattggtatgtatcttgtactgcaaaatacattttaatgccatgaaagaatatgctgtctctttattcatcagctttatagcttttatttatatatgacttcttagaaaagtataaaaagatattaaagtcattccat

SEQ ID NO: 90450 - DNA, 252 bp, Homo sapiens
cagaggcaccaaggaggccaaaggcaccaaggaggactgactgctcttccagatgacagtgtcatatgatgaacgaagctgaagccaaacagcagaggcctgaattatataggcgtatcggccagggtctgatcaggcgacagaaatcactccagttatttaatttttttttttttttttttgagacggagtctcactctgttgcccaggctggtctcgaactgctaatctcaggtgatctgcctgccgcgt

SEQ ID NO: 90451 - DNA, 751 bp, Homo sapiens
tgagatggagtctcgctctgtcgtccaggctggagtgcagtggcgccatcttggctcactgcaagctccgcctcctgggctcacgccattctcctgccttaacctcccaagtagctgggactacaggcgaccactgccacgcctggctaattttttgtatttttagtagagatggggtttcaccgtgtcagccaggatggtgtcgatctcctgacttcgtgatccgcccgccttggcctcccaaagtgctgggattacaggcgtgagccaccgtgccctgccaatatgctggctcttaagcacaggagagttgagttgaaatctgttgttttctaccacattcttcaaaaacacatcaaataagtttttaaaataattcaaaagtaatcatgactttgagaagaccaatgcatgacttgctagaaaatatacgagaggttctaacttcgagtttgctctcgtgctcttgttcctcaaagaaatccagcactcccaatgcaatatgaagtatggatcagagaggctgcttagaggactgactgctcttccagatgacagtgtcatatgatgaacgaagctgaagccaaacagcagaggcctgaattatataggcgtatcggccagggtctgatcaggcgacagaaatcactccagttatttaatttttttttttttttttttgagacggagtctcactctgttgcccaggctggtctcgaactgctaatctcaggtgatctgcctgccgcgt

SEQ ID NO: 90452 - DNA, 513 bp, Homo sapiens
gggggaggcgggggcagccacctggcccggacagctgcaggtccggacggccgtcaacaaagtggtgtagtcactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacaggtatatgtatgtattttttacaaaattggatgaagtataatttatttgttaaatattttcacttatgccatgatatcttatttaatctttaatttgtctatgaaaatacctgctctgctagggggcttctagttgaaaactcattaatttaaaaaattaattttgaattcagccacctattcttttttctaattgtttcttgtagcttttgctttgattggaataactttattctaggaataaagttttgtcatctgcaaacatgaaacatg

SEQ ID NO: 90453 - DNA, 198 bp, Homo sapiens
agtgggccgtggactctcaccgtctccccaccactgccctcctgggtcgtcttgactgcccccagctctggcaagtgcctcctgcaggatcccagcctcccctgcagggatcctttgctcattcgcccctcccccgactgatctctgctgtatattcaggactcacaggaaaccacattatttaaactcatcataatt

SEQ ID NO: 90454 - DNA, 391 bp, Homo sapiens
cagtccccaaagccccttgtaaatattcatgaactcaaccataacttaatatacttgagagaattatctttcactaccatcatatgactgaatttaaatttatctaatgtgtttaactttttacaggttaaaaaatttacagatagtttttataagaatggtttggtttatatactcttttcatttctaagttttaatcagttatctactttttagtttactgtttctcttctgttcaatattttaaaacttattcaggaatatgaaaagatatgacagttttattttgacttctgcattttgattgggtccttcagtgaaaaatacagtagcagaatttctaatgataaatatttaatgtaaatactgcaaataaaatataatttcttgt

SEQ ID NO: 90455 - DNA, 947 bp, Homo sapiens
ggtctcgatctgtcacccaggctggagtacagtgatgtaatcactgctcactgcagcctcaaactcctgggctcaagcatctcactctgtcacccaggccggagtgcagtggcacgatcatagctcactgcagcctcaaactcctggactcaagcagtcttcctgccttagcctcccaaagtgatgggattacaggtgtgagccactatgcccagcctacactttattttttaattaacagcactgataaccatattcactgatttgtgaagcctctcactaggattcttagagactaagcgccatcaatgaccaatataaagaattcttaaaatatctcatgctaccttaaaaagaaatttgtctctaaactcacattgctgaacaacagctgttttctatcggttgcacaagcaatgacaatgtaaaaagtgctaagagtagtttgggtttgtgtgtaaaatggaattaggtcctaggctgaataattataaacatattttaacaaatgaatgtctaggtgagatatcctaaagttgtgctggacatatgagacatctagtatgcctggcccctgactacaaagtgccagctacactttcccattaatatggcaaccaaaaactttctttcactttttcaaagggtccactagagggcagtactaaccccagtgagaaccctggcattctcatttagcttccagaactcccttgggaacaggaaacacattcttttaatctcagaatccctaatgttgaacagagtgcctaacgtgtacagtaggtgttcagtagtcatgatggaccaaggctatgatagagggtgccatggaggcacaaaggagggtgagatcaatctaacaagggaaccgaagggagagggaaatcttcacaggtgatgtaagaaagttgccttaatagaggatttggggctaggtgagctgg

SEQ ID NO: 90456 - DNA, 919 bp, Homo sapiens
gtgaaatatgtctttaaatagaaatacgtgcctacatttatatatatatattcctgtatattttaagtgtaatctttgagaaatcaaatttattatgtatatcacagtgtctgtaggcaaatgatgagcaatacatggcttataaaaaatatgctacattaggaattccttcatgtaattgattagaaaattagaggcctagaaagtttcaaatttagccaagccatcattgttggacttcatgccctaatatagtcaactggttatttatgaaagagagaagatgaagttagacaggttattaattaactgaatagcatgtaaaactttctcaggactatatccaaaaataaaatgaaaaagaatgctgtgtaagtattcattatggtctattcattaaaaggaaaactattctaggtgtttcaaatgagaaggggcaggtagttaatacagtaaattagtcataagagtttgaaaggctagaacagcaaaaggtagataagagtgaatttgggaatcaaaagtaatattggtgagcccctgagtctgcacccaattttgtgctattagtcttgcagttagccatggattcaacagggatgttgcctccattgaggctagaaatgctctaaaggatatagctcttcttaggctatctgcccttggaaagaatcactttagcccagctaatatggccacttccaggaactatcatactgctagaaacagaagcagaaaatttcttttttttttttcttttaatcaaccttcttagttccttcagtgcctcctactgccaaaatttaaaagaagtcagttacgaagaaatcagggaaaatatagttcactggaaaacggtttcgtctattttaaaattcggatatgaggctggactcagcagctcgtgcctgtaatccca

SEQ ID NO: 90457 - DNA, 446 bp, Homo sapiens
ataagtgccaaaatccaaactgaacacatctaaaaaaattctaattaaggagcgtccactgctgctttctcaaaaattccttctgtgctattaaatattttctctttccaatggatatttaccatttctactcacagtagtttttctaccaagtattcagaaaaacctccagttgtcacttacccagtgtttaccaaaaatcaggcagaagagcgtggtggaagttggaagaccttagtgtaacccgcgtctataaaaactgggcgtccaggccgggcacggtggctcacgcctgtattcccagcacgttgggagtccaaggcaggaggatcacttgagtccaggagttcaagaccagcccggacaacatagaaaaaccctgtctgtacaagaaatttaaaaattagctgggtgtggttgtatgtgtgcgtcatcctagctacttg

SEQ ID NO: 90458 - DNA, 287 bp, Homo sapiens
atctcttcacatttcgatgtatcatggcatgttagattttaatgttggcgagtgaggcttcttgaatcaaaaattacactggataaagtcaaacagacaaggaagactgtattcaaggccgctgcaataggggaaggaggccagaactaagtgtgaactcaactcctctgaaacaaaaggcagaagggtttttaagggccaggatgagctagtggaaaaatactgaaagatattatgtggggcagttaatcgggtgtgttgggcacacattatggaggggtaccgag

SEQ ID NO: 90459 - DNA, 523 bp, Homo sapiens
cttccccggggcaaaacagtctctcaagtttaggaactgtcaggagtgaatgtgagatgcgtggaaatctgtccatgttgagccctagaagggggcacactgggccagccaagaagggaagcctttaatcaggaaaatctgactggcataaggtcatgggattgtcttgaaaggtcttctttgattcctttcctatgggctaacagggcgggggacactgagcttcatttggagataagggaaggcaggaaaggagatttaaagtcaaataaaaaggggccaatgggacaacaccaaacttaaccacaggagagaggaggaaggaaaggggaaagaaacacgcaaggtccaagtgtccgtcaggtaccaggatcactgaatcacctcctcaaatttcacacaaccactgtgagcagatatcagtatcttctttctacaggtgcagaagcgaggtcaagagtggttcaatgacctcccttagatcaccctgctgataaagtagaccagcagggacttgaagctt

SEQ ID NO: 90460 - DNA, 729 bp, Homo sapiens
aagaccagtcaaggggctgtgtattgtcagattggggtgtgactgtgccggaaatttatcttgtaaattagcaggatcctgtttttgccatactgaaagtttcctgacctattggttctactgagctgatactggccgttgtctcaagggagactgagtattataacatggaagaaaattcccaggtctacaagcagaattgctccgaacccaagataaatcaggtcataggaaagcaagcatctcaaataaaagtgaaaacgtgttaaacacacatatataaagtttccctttatgactaagacaagagaaaggcaggtagcatccattcaactctgtgctggattctgccctaggcctttctgactgactcttccaagctgcttggggttgattccaagcttctggcaagtttctctggagcattttatttttccttgggtgtgtgaatggaagtgttttgtatttaacatcactatattgtttcccatcagatgttctaatgttaataaatccacatccactgcatcccatcccctcttcccagcagattttatatgttacgtagattaggcatctggtttctgagagaatattaaatacttggacatactttgatcctgtgtatttcctgctgtaattttccctctgctcagaactcagactcttgagtttctgattcaacacattgttaatacacattaaagactcaagcatctaaacagacta

SEQ ID NO: 90461 - DNA, 730 bp, Homo sapiens
ctatcgattcggctggaccccacacctagtcttgcagaatggatgattcacctcattttagagtacaagcagcaggatcctgtttttgccatactgaaagtttcctgacctattggttctactgagctgatactggccgttgtctcaagggagactgagtattataacatggaagaaaattcccaggtctacaagcagaattgctccgaacccaagataaatcaggtcataggaaagcaagcatctcaaataaaagtgaaaacgtgttaaacacacatatataaagtttccctttatgactaagacaagagaaaggcaggtagcatccattcaactctgtgctggattctgccctaggcctttctgactgactcttccaagctgcttggggttgattccaagcttctggcaagtttctctggagcattttatttttccttgggtgtgtgaatggaagtgttttgtatttaacatcactatattgtttcccatcagatgttctaatgttaataaatccacatccactgcatcccatcccctcttcccagcagattttatatgttacgtagattaggcatctggtttctgagagaatattaaatacttggacatactttgatcctgtgtatttcctgctgtaattttccctctgctcagaactcagactcttgagtttctgattcaacacattgttaatacacattaaagactcaagcatctaaacagacta

SEQ ID NO: 90462 - DNA, 611 bp, Homo sapiens
ctatcgattcggctggaccccacacctagtcttgcagaatggatgattcacctcattttagagtacaagcagcaggatcctgtttttgccatactgaaagtttcctgacctattggttctactgagctgatactggccgttgtctcaagggagactgagtattataacatggaagaaaattcccaggtctacaagcagaattgctccgaacccaagataaatcaggtcataggaaagcaagcatctcaaataaaagtgaaaacgtgttaaacacacatatataaagtttccctttatgactaagacaagagaaaggcaggtagcatccattcaactctgtgctggattctgccctaggcctttctgactgactcttccttcagctgccagcaaatagtctaaggccaatctattctgatagatggcatttctcatttgggtttcctgctgggctaaaagagttaaagctctgccagtttcactagtgattatttctaagatggcctgtaaccgtatgatccagttgagcatgtagatgggggtgtggtatccctatgagtcgtcttgtgcccatgtggcaggcctatagtactgtatgatcctttcggggc

SEQ ID NO: 90463 - DNA, 588 bp, Homo sapiens
ggaaaagacatgctatgtgtagggcttggtactatctgtggttttaggcattcactcgggagtcttggatgccctgcaggtaaggggggattcctgtatattaataaaagtattggttgggttttatttatcactcttcatgtatatgatctcatggatacaaacaggtgaccttgccaattggtgctttttgtgtgtttaagaaaagaacagtagtaaccttgctccctggataccaataaaaaatctattatttttttaaaagaattttggacctctagttaaaagatcattgtttcccaactgcatgactctatcttgaaacatttacttattgttctttattaaacatatttttaattatcctatgttttaaataatttcttccaagattgcttcctttcaagagaacttttaaacattcagttaaataagaaccctttaaatttctgttaattgtttcaaatgttacataatttgtatggacccattgacagttgtaaactttcagaatattgcgtgtgaatttcaaaaaaatttgtaaaatattcgcatacattgaaattcattaaactatgttttctcata

SEQ ID NO: 90464 - DNA, 1046 bp, Homo sapiens
tcggcggaaagttctccattcacccgcggctgggcactattcgcacccggaagcccctggatcacgagacgcagcccgtggttgtgctcacggtgcaggcgcagctcggcagcgccccagcctgcagcagcaccgaggtcaacataacagtcatggatgtcaatgacaaccacccagcgttcctcaggacctcggatgagattagaatatcccagaccacgccccctggcacagccttgtacctcgcacgtgcggaagacagagacagtgggcggaacggactcatccggtactccatcgccagcccgcagccaggcgtctttgccatcgacagagccctgggggtgctgttcctcaacggcagcctgggcgcgggcgagcagcgggagctcacgctgactctcagggccgaggaccaaggcgtgcatcctcaggcagccctgctggtgctgacagtcgttatcgagaaacgcgaacacagcccatcctggactttcgaacatttggtctatcaagtggaagtcagtgagtctctctcaccgatgacacaaatgctgcaaacacaggcgcacccacttggcccccagcgtgcagcctcgcctcttaggtactcgctggaacccagcgtagactctgctatgtttggaatccgcccttacacgggctggatttatttgcggcgacagtttgactatgaatccacccaaacatataattttagagtgtttgcttggatccccgaggacggattcttgcaaaatgtgagcactacagtcattgttcgcgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggtagcacttcatagtttccacctattcctttaaaatgagggttcagtactatcacactcgtctttaagtaa

SEQ ID NO: 90465 - DNA, 477 bp, Homo sapiens
atcacatatgttatacttttaatgggaacaggcaagtcagataatgttagataaattctgtagcactgaggacaccatgttaggtgccatccattgacttccatgatgggaaggatgcattccttaccttggggacacaggccctttatgaaaatcagcctcactgttaggttgacttaatttagttcctataatttctttaatgattgtatccatttttctgccatcttcttggttcagtgctgaaaccccagaaaattagtacatagtctgttgccatgtcactttgtgagccaagtgaaaaaggacaaaacaagcggttctgtttttaaatatctaggagaaatcaacaagcttcaggcatatactgaatctgtgtgtttacgcctatgcttattccagaaactaaaataatttctgaaattcctttcaaaaagccaagttaaatgacacgactttctcactgtattctaaaga

SEQ ID NO: 90466 - DNA, 330 bp, Homo sapiens
tttcattccagaactcttgagcatcttcctcagcaataaccagcagccttcagcagggagaacatcatcttaaattgctgcccatttctttgcacagtacacaaaatatgtacattcagttgtcattcttagttcacattcttttttttttttttttaaaggggaaagcccgggcttttgggccagggggggggggcagggggggaacttggggctcagggaaccctttgccccgggggtcaagcaattctccggtgcttaggcctccagggagcggggattacggggatggaccacacaacaccaggcctaggaaggaaattcaaaggc

SEQ ID NO: 90467 - DNA, 347 bp, Homo sapiens
cccttacagagtttcactctgttgcccaggctggattgcagtggcacgatctcggctcactgcaaggatccgcctcccgggttcacgccattctcctgccttagcctcccgagtagctgggactacaggcggccgccatcacacccggctaagtttttgtatttttagtagagacggggtttcactgtgttagccaggatggtctcgatcgcctgacctcgtgatccacccacctcggccatgaataagaatttgagaaattctggttattttattactacgtggtgtagcgagccagttaaggatttaaatctgaaagtgtagcacagtcgtgcttatgttgagga

SEQ ID NO: 90468 - DNA, 428 bp, Homo sapiens
aacatttttttatggctataatcataaaggcttcttggcagatttatttttggttttgtgagatataacatttgctatgttagtttttttattaaagaaaagcataaaaatatatctaaaagtactaatctaaaaatcattcaggacggcaacagaaaaaaaatattttaaaggcagagatggttaataaccacctgtatgaaacctaattgttgcttttgcagatatcgctataaagcatgcttacccctaacctttttattctaactcggtgcttaatctaggctgcctattttattataaagtgcactgtaaaagtatacactttcaaaactttaaacatgaaacttatgtgatattattgaacacctttcactgttacatacttatctgtgcagatatatttattaccaagtgagtggtccttt

SEQ ID NO: 90469 - DNA, 167 bp, Homo sapiens
actctcaggtgatccacccacctcggcctcccaaagtgttgggattacaggcgtgagccaccgcgcccagcctatattttaattattattatctaaaaaaattcatcctcactacttgagatctgtttgtgtgtgtgactcaacgggcgtttcgtttctctcccaaa

SEQ ID NO: 90470 - DNA, 470 bp, Homo sapiens
tgtatgtaaggaattcaatattgattcacttattaattctcacagtgaataaacatccaacacagtgaatcagtattcatagtttgatgtttacccttagaaaaatttccaaagatttttaaatgtgttccttcctccatcttcaaatgattatgcttatttcactgcaatgaggattgacaaagcttctcacattgccattctggaagtggtaacaatgtaacatacttttgcaaattttataaaactatacaaccatgtgaaacacatggctagggaaccttccaagggctcctaagggtcatgtccaagagaagggccctgaaacttaagcttcattagagtcacgataagatagcttctaagtcactgagggtatgaatgcaaaattgcaaatactgaatgtttcctccagataataaggattaaaagatcaagaggcagataaagagagctacctaggaagttgt

SEQ ID NO: 90471 - DNA, 322 bp, Homo sapiens
tttctgccaagctctcttgagtgatactccctttactgtcatcgttagattgcattgatctgacagcagcatagataagataggcttttttggattataaacaattctagcagtttactctaattctgtccttttctcctacctgatcaccctgtgttccaccatcctatgaaaacactgctgtagggtccacacttttccttagtgagatccaggtgaatagcttacctttctgagctgttttctgcatccataaaatgaaagtaatataatcacgtgccttccttggtttagtgaggatgttgtgaaattcagtagatgt

SEQ ID NO: 90472 - DNA, 214 bp, Homo sapiens
tgcactccagcctgggtgacagagcaaaactctgtctcaaaaaaaaaccccactctaccaaaataacacatcacaacagattaaatacagaagcagttatgagcatccagctatcgtctatattaaaccagatattaaagagattttcaaaatgaaaaacaaatgtcacccttctcattaaacttttatcttagtaaatgccgtaatttttcat

SEQ ID NO: 90473 - DNA, 392 bp, Homo sapiens
actcccagtcccattagactagatgcctgtagaaggcagggtcttggcacaatatcaatgtattcaatttcttttatttttttgagacagacttgccctgtcccccaagctggatcctggcctcaaatgatcctcctgcctcagcctccctagtacctgggactatagatgagcaccaccatgtccagggctaatttttgtattttaatagagatggggtttcaccatgttggccagactggtcttgaattcttgattcacctgtgtcagcttcccaaagtgctgagattacaggcatgagtcacctgcctggccagggtcttgctctttatccaacttgccactctgtgacttttcattggggcacttagccccttcactttcaaggttaa

SEQ ID NO: 90474 - DNA, 1864 bp, Homo sapiens
  misc_feature (1)..(3): n is a, c, g, or t
  misc_feature (130)..(130): n is a, c, g, or t
nnnttgctggattaggaatgaggcgccaaaggaagcacagccaggaaaatggccccacagcctagatcagcatctgtgggaaaggaaaaagggttcccatggggacagcccccataggagttttctgganccagtaacactgaaaaataagtgtgtggctacagatgagcacgcccaccccttgcaactccctgtttacaagttgtccgaggcattggagtgcttatggtcaatgggctctagggaagtaggaaactccatcatgatacaaatgtctagtaattttaaagtttctttccctttttttctgtgctggaaatgttcacagatttgattcccgccccaagaattacaacaatgtattcatacagtcagttggaatccaaaggcaattaattctattttgcaaaatatgatggtcttcctaaaaaacaagtactgagttctcatttcaaaagttaccaagaactgaattctttaaactagcaaaccgaagtaacatgaccatttttgccttagtgggaggtttcaaatgtgcagctcatggcatttacctgccgaccatcttttgccaagtttagaattcttatgcgtttcaagttctatatagaaagtaattttacttttgatttttctcttgttaaaaaaaaactcctttattctaagaacaatgtctcaaagtctcatttttactttaaaggtataagagacttctaaagagacttacgggatataaaagtaattcctggaaatgatatttgatgaggagaatgtaagagaatgaaaaacacattgatgttttcatttttaaaaaatacaactagcatgagaaatcaagaaaatatgtttaccaaaatgcattgcaattttcccaaacctgagtcttcaaataacaaacatgaacttataggtactgtgaactagaagaattggttatatccagatttctgggagataaattaaaacatatttttgtggcataaataagctgattcagaagttacatttcttaactttaggtagaggagaatatttgtatccttttgttgctatgcaactgtttaatgatgaagcttcaaaccacaattttgtatatcatatgacaatcaattgttttccaagaatatttattattttaagtacacaatttcagtgaatcttgagtttttctaggagtcccttaaagggaaattagcattccatgagccagtaaaatacctactctggtaaaacattattatggttaaaaagtaaattcaagttagttttttataaagaactataacatttattttaaacattttataataactgaaaacattaaagtgagcaaatgaaatttcaaaaccacttgtaataatgtattttataatcgcactgtgatactatataacacagtctcttttgtattaaaatagtatttttttcacaagctgaaaaatatcttttcctttgttgacaatgttttgtaagatgactttattttcagatctttttctccttttttgcacaaaactatgcttatggtttgtgtcacagaagtgaaaatatatctttgcatttttatatctggtctgtttttcttgtttcctttgtttttaacttgatatagattttcttcaaatatataatggcaattttcagatatctcaccttaccatatctttccttattttcactgcatgcatttaatcactgtattacttaatgtttgatttgttattatgggcatttcaaataggcaagcattgaattgtaatgacaaaaaggctattttatattaaggatatatgcatttgtatttcacacaccagagatgatattaaacactgattattttatgctgctgtttattaaaaatgtt

SEQ ID NO: 90475 - DNA, 5104 bp, Homo sapiens
  misc_feature (380)..(380): n is a, c, g, or t
  misc_feature (678)..(678): n is a, c, g, or t
  misc_feature (820)..(820): n is a, c, g, or t
  misc_feature (856)..(856): n is a, c, g, or t
  misc_feature (1343)..(1343): n is a, c, g, or t
  misc_feature (1430)..(1430): n is a, c, g, or t
  misc_feature (1698)..(1698): n is a, c, g, or t
  misc_feature (1781)..(1781): n is a, c, g, or t
  misc_feature (1879)..(1879): n is a, c, g, or t
  misc_feature (1932)..(1932): n is a, c, g, or t
  misc_feature (2010)..(2010): n is a, c, g, or t
  misc_feature (2410)..(2410): n is a, c, g, or t
  misc_feature (2624)..(2624): n is a, c, g, or t
  misc_feature (2921)..(2921): n is a, c, g, or t
  misc_feature (3657)..(3657): n is a, c, g, or t
  misc_feature (4136)..(4136): n is a, c, g, or t
  misc_feature (4934)..(4934): n is a, c, g, or t
gaaatgggtggcagatgttgtactgttctgatgtactgcagagtgctatagtaggtcagaggatgaagcactgtggaccagtgtggtcagggaagcttcctgcagagtcagggagtgagctggaccttaatgttcatttcggttccgtaaacatttgagagctcgctctaggctagactctgttgggctttggctctacagtggtgaaaaaggcactgttcctgcccagatggatcgtctatcgtgtgtcagagggtggatattgtttgcatggatataatgttgtctttgctgatgacaattgccatatatattcctgtaatttgtgtgtgtgtgctatgtccattatttagtgtagccctcataacatctctctacanctttgtattaatatccttgctgtacagttggggaacctgaggttctgagatgttaatgaaattgtctgaggttgcagagccagatgatggcagatctgagatttgaatttgtgtctgtgtgtttttctatctataagacactgcttcaaaaaggtgaagggaagaggcacccttaaacagagttatgaatgactgtggtatgtgtgtgttttggacatggaagagtttggtgaagtgttggagagtagtggaaagcaaagcgggatcgacaggtgggaccagacatacatagtcatgnttataaacaatagtaataaatgtttgtggcatgaaagaagacagtgcttttggtttgggccgtattccaagaccataagaagactctcatattcaaatagaattgtcaaaaaatcaaatgtgagtgtaaaaattaccattcnattcagtgcattttttcaccaatgtggataactganagttgacagcactggctatgcttaatcaattatggaaataatagtcttaaagaagtaacagacatcagtcaccatgatactatgataatgtacacatgagcctaactcttaattgtagccagttattgtaaactgaagggatttgaggaacagcttttctttttttttttttttcagacagagtcttactctgtctcccaggctggagtgcagtggttgaatctcggctcactgcaagctctgcctcttgggttcatgccattctcctgccttagcctcccgagtagctgggactacaggcacctatcaccacgcctggctaattttttgtatttttagtagagacgggatttcaccgtgttagccaggatggtctcaatctcctgacctcgtgatccgcccgcctcggcctcccaaagtactggggttcaggcgtgagccaccgcgcccagccgaggaacagctcttcttttaaatgtcttagganttcttattttgaataaggaacctttctagcaaagaggcagaaatgaaacttttgttttatatttaggtcagaatttcatttcacctnaactggctatctatttttataccaaagctcagtagtgtgagttaattttttatcactgtaatagttatacatattggtaaatgctaagaatgaaaaatagcaatgttctaactcctgtctccccccctccccccacctgttgtcctggccacttaacaaaggctcatactattatttttttgatgaatcaattttaggattttgtctattgacttcattcccatctcgttaggctgagatttagcactcttctctttctttcatagtnactcaacccagctttgccctatcatctaatcattccagtattactgtatcacaaatattggttattattcagtgtttacactntttaaactatgtcactgttattcccagatgagccaagtagggtactatgattgtattccttcattatttaactcttttctcctcatgataaaaatttnccccccagtggtttagtttatctattgcaaaaccttcctacatcttcagcatnatttcatacattcaaaccaattagatggtttatcagttcatttttttgttttgttttgtttttgtttttttcctgaanacctccatctgagagtcctttgtcatccttctgctctctggattggttgctcagtgggcctgctgcccaggtgatttcctgaacttccttttaatcatcatcttgggaattctctttgccccctatttattccacgtgtcgtttatggaatcttgtatttttttggttaaactcctttttgttggaacataatctccagtatcttcctaagaaagtatttgtaagtcataaagtataagacttttaatctctgtaaatgtcttaattgctttcacacttgatagtttggctgggtacagatttctaggtagttttcttcagaattttgtcttcacatttccagagtttttagaagcatagtagttaagagctcaggccccggagctagactcagtttacnttctagctccatcacttagtaatgccatgactttaaatatattatctaatttatctttatagttgtcccttgactatcatggtttgaactttgtggatccacttatatgtggaattttttcaatcaaatacggatcaaaaatacagtatttctgggatgcaaaatccatgtttatatggagaggattatacacaaaatcaacgtttgtatgctnaagttcttgtgggctgactgcgggatttgagtatgtgagaatttgggtatacgtgcacagtcctgcaaccatcccccttgtgtaccagactgtactatgattttctcatttgtgaaatggatttataaataatactttcctcatatgggatttgttgtaaggattcagtggttactatagccatttagaaaagtggctggcacatgatgagggctttttaaaattgactattattactctaggtcctttatatgtgacctaaaaaacattcaaaagtttatgcatgtgttctttttnctaggtattctgaaatttcataatggtctgctttagtaacttttttcacattaacaaggtagagacccatttggtggaaacgatgctcttcagttccagggctttttggttgttgttgctttaagaattactacccacctgcatcctggattttctctgttttctctaacctactagtcagatgtttaacctcttagaataacttcctgacttttaaagttttacatgtttgactttctgagagatttccttactttattttttaagcttttctaatcaaaattatttcagagccatgatggttttcatttctaacatcttgttctaatctactggctgctccagttcttattttatgggcactatattttctcatacttctgtgaggatacaaattatggttttaaacaattttttttttgtccatgcattagatctgctttttttgaggttttttaaagaggtgtgtgtgagtgtgtataggggtggttctgtgtgaatctccccaccaccacccagattttttataattgaggtcttctttaaatgtctaatgatccttgactatttattcaaatgtaagagtagtgcaccatgaatctctttggcatcttttgtgtgtgtatatgtagggggtgtttagctggtgagctttattgtattatataatgacctgggggagaaccagctgttttcttgggactgccaaaggtcagcatccaagcagctttctccntagtggtccagtttctttcagtaagaaacttccagtcacacacctgtgaatatactcctgttgccagcattctcagagctggtgtgtgtgtgtgtgtgtgtgtgtgtgtgtgtgctgggaaagaggtagacctagttatatgaaagttggaggagcaggaggagggaggaggaggagctaatattgagtatttattttgtaccagacaccatcctaagtgctatagctcactcagtcctcacatcagctctgcagctttgcacctgttattgtcatcttttttttttagatgaggaaagtgaggtacagagacgttaagcagcttgcccaaagtaaggcatctctgctaattgacagagctgaaattgaactcaggaaccttctagattctatgtatttggcttttcacaacatcattcttgttttcaatccttgtcactatctctgctgtgcctgagattcccaaaacgagttgtggntaacccagagaataacccttcagtgcctgatgttggtggagagaagaattgcctagttacatctcatatggctcagcaggggagaggagtgccctcatggttgctaaatgtgggaatggaatgtgaggcaggaggcaggtgagaggttagtacaggtgggaggtgtccccgctgtgtggggaggagggacttttgccactagttctgttacaggtttgggattctaggacactggacactaatgtgcctaatctgtaaggcattctagactgcatcttgtgcagttcattcatcttcccgcctcgcaagccagcagagcctgacttggggcctcagctctgcatggagctacctattgggccttcaacagcgagggttttagtcagaaacacagaaatgaatccttagtgcactgggcagtgggtatcgtattttactaggaggtttttgtctagaagttggtcatttctctgggatatggtataggatgggtgggaagggtgccacaaggaaaaacatgagaatttgtactgtgcaacagtttggtgtttccagttgggtccacccacaaccttgactccaaacttccaaaacaaacacacctgtgcattttgcccaagattctattgctgggtgtttttattgtaccttctggcaacctacatttggtttctcttcctcattgttgctgttttagggaattcttactgacatgtgttgttttttccacttggcctagttagatttggtctactaaaatacagaggagattgtctctatcttagggacttttctttntcctcctagtcaagctcacttccagcctttctttttcctccctgtatataatccctgtgacaacgtttaaggcaaaaccgagatttgtatgttttagctctgttctttctttgctgattaaatttttagagtttaaggaagagttcattaatcagaaccttaacattaaa

SEQ ID NO: 90476 - DNA, 501 bp, Homo sapiens
catcgatgccactcggaggtgcaaagcaacatccacatctcactcctcccggggcttttggcggtattccggcagcgctttctccgccacggtctccataaatttagggttcttccgggagaccgtggcatcgataaacaccggggtttatctatccacctgggaaatctctcaatcagcatttatttcaataatcacatacagagctctggcacttttttccacaaatgcttccaaagcagtttgtaaattttatatagctggggagttactgtggcaggaatagaaggaaatagatatttatcagcttcctaatgagaactggagactcagtgtacttttgttgagaagaacagggatccaagaatgtgtatttaattcagaatgtgtgtgtatttaaatgacatagtatttcattaaaatgtttttcatatttcctcctaatcatccattcaaattctacataactttcaaggcccaccctctagaatcagcttctag

SEQ ID NO: 90477 - DNA, 273 bp, Homo sapiens
catgcatgcactttgcaaagggatattcctaggaaggaagcatctggcatcccggaaaccagcattcattcactgtcagaggaaccagttgttttgccttagtccttccaacataagccctatgatacttcactaaagggactcctgcatgtgatgctgcgtttcctaggaaagaaaaatagtcaggagaccttctgatgcaattgactggagatggaaagccttatgtaactaacctgcacaatgtgcacatgtacactaaaacttagagta

SEQ ID NO: 90478 - DNA, 350 bp, Homo sapiens
tctgtaaggcatgctaggctacttagggagtttggacttgatttcagagcaatacagtgccagcgaagagtataaatatgattagattgacatttaattaaaataactctggcttgctaattggaaatgcgattggaaaatgaaaaaactggagttgaaagggaacagctagacaatcattcaggtgctagtgctttgaactaagatagtgaaatggagatatctggacttcattggatttaatgattaattggatatggggaatgagggagtggaggaatcaagagcaacactgatgaattatttcacgaaagtattgttttgacagagttatctatggcatcctggtg

SEQ ID NO: 90479 - DNA, 475 bp, Homo sapiens
cattcttctgttagacatcagccagatgggtttgggtggagagaaggtagccaaagatctacaaaaaagcaaatagtatgtgacacatttcctacaaaatatgcttatctatagccagtccacattctgaatttagatgggaaggtgaattgcagccaagcctccctccaacagtttgggggaagatttctcttagggaattaatgaggaattatattaattagggtaaaaattaagctgtcgtaacaaagacactcccaaaatgcagcggcataatgaagacagacagtttatttctcattaatgtgataggtctgaggtgagagtacatgttgattgggtggcactattctgaataattaatcagagacaatgatttctttatggtgagccccactatctcactgggtattatctttgtctctgtagttgtagttgatgctgggtcataggcatgtccatgttccagctaata

SEQ ID NO: 90480 - DNA, 253 bp, Homo sapiens
gaatgtgtaggttaacatttttcagcaaatttgggagcttttcagctattatttcttggacattttttctgcttggaactttttttctgcttctttctctctcacatctcctctggtactctcattaaggatgtcccaagcttctattcatttttcttaattatttttccctctctgtttttcaggttgtataatctctattgacataacttcaagtctgctggttctttcttctgactgttccaatttactg

SEQ ID NO: 90481 - DNA, 686 bp, Homo sapiens
catggtgggaagcatgaaatcatggtggctctggagtcagggggttgtgtgagtgacctagctttatcctctgtgagccacagtttctgcatctgtgcaatgtgtgatgatgacagtgccctcctcatagaactgtcatgaggactaaatgagatcaacagatatagaacagctggcacaagcaggaacacaataatatgggccctttcctttctctttcccctcttcacatgataggaaaaagatgtcatcactcctttaaaatatctctcttgcaagtttttgagagagaatgaaaatgggagcctcaaatagctaagcttatcctctttatagctcctggaagtaaatcttatcaagcttgggatttggagtcagacaaacatagcttcagatccaagctccaccaattacaagctatgtgatcttaaacacatcagttaatctcttctaatctgtcttctcaagagctaaatcatatctaagaatatggttgtttagaaagttaaatgggtggtgtatgtaaagtgtctaggacagtatcttatacacagtcagaactcaataagtggtcactcttttaagaactgtcttgggtgtggcacagggagtgcacagaaaaatggagagcagagtgtccacagacatcactattatttttcataatcatcagcaatccttggttc

SEQ ID NO: 90482 - DNA, 262 bp, Homo sapiens
tgatagcattttttgatagtagccatcctaatgggtgtgaggtgctgccatcatttctttttgaaatcaagtgtccagtgcatgtggtctgaaaacttaataggattctaaagtgtccacatcacacctgaaatgtttgcataggtctgtactgtcaggcaaacgtgtgcactcacacatcactctcacctctgtctgtgcccggagcatgattccagttggttcttggtgtcgaggttgtcagtgatggtgatctggtgcc

SEQ ID NO: 90483 - DNA, 366 bp, Homo sapiens
cagttagtgaggctgtggtgttcactagggacatgctctgtcactcagtagcattttgtgagagataccatgagggtcttatttactcagaagtcaaaacattggagtctccagaaaatatttaaaaatcatacaaaattttcagcatgtcttaagtaacaacccagtggcatatctgcttgtgctataagttttatctataataatataattagctcataatttgtgttaaggtagaagtgctaaaattactaccttaaataaaaatttcaacttaatcaaacatatgttgagcatttgcagaagggaaatggagatattaaagtaactaggcaaagtttctaccccaagagctgtatatcagtg

SEQ ID NO: 90484 - DNA, 288 bp, Homo sapiens
tctcacaagcattatgtgtttgagaaagaagctacattcagaaacctgtgattccattcattctggaaaggaaaaaatgaaagtaacagaaaagtcatgattgttagaggcaaaaggtagtggtacatgattgcctacaaatggacaggacaaatttttgagtgttaaaatactgtgtatcttaattgtagattatatatttttcaaaattcgtagatttgtaccacgaaaaaagggtgaattttactctaaagtatacttcaataaacctgattttcaaaaggaagg

SEQ ID NO: 90485 - DNA, 1248 bp, Homo sapiens
cgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90486 - DNA, 814 bp, Homo sapiens
gcttcgcagagcaccggacttggagtcagagagacctggctgcgaatcccggctccgccactttctagcgctgtgaccttggcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90487 - DNA, 934 bp, Homo sapiens
  misc_feature (919)..(919): n is a, c, g, or t
  misc_feature (925)..(925): n is a, c, g, or t
cgccagccgctgctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctcccacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaaaaaaaaaaaaanaattcntccaggcct

SEQ ID NO: 90488 - DNA, 1369 bp, Homo sapiens
cgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90489 - DNA, 993 bp, Homo sapiens
gggaacggacgctcagggccccggtggcctgggtgcacgcgcccgccgtgcaagggatgctcccggccgcccccggttccgcggctccatctgggatgcggcgaggagggcagccgagctgtccgcaaacaacgggccttttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90490 - DNA, 1028 bp, Homo sapiens
cgccagccgctgctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctccttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90491 - DNA, 1416 bp, Homo sapiens
cgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagagcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90492 - DNA, 1275 bp, Homo sapiens
  misc_feature (1260)..(1260): n is a, c, g, or t
  misc_feature (1266)..(1266): n is a, c, g, or t
cgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaaaaaaaaaaaaanaattcntccaggcct

SEQ ID NO: 90493 - DNA, 1108 bp, Homo sapiens
cgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90494 - DNA, 1082 bp, Homo sapiens
cgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90495 - DNA, 907 bp, Homo sapiens
cgccagccgctgctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctcccacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90496 - DNA, 935 bp, Homo sapiens
gcttcgcagagcaccggacttggagtcagagagacctggctgcgaatcccggctccgccactttctagcgctgtgaccttggttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90497 - DNA, 811 bp, Homo sapiens
cgccagccgctgctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctcccacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 90498 - DNA, 398 bp, Homo sapiens
atgttgctcaagctggtctcaaacttgtgagcccaagcaatttgcccaccttggccttccgaagtactgagactacagacgtgagtcactgcgcccagcccattttcagatgaatttagtccctctcttcctttatcagaataatgttctttgtcattatgctcctcagaagtgtatttcttagaggatttgttgtaggattcctgtcttcttgcctcatcatgaaataggcttattattttcctacctgagtctgcaatgtcttcagttcagcctctttgcccatcagcatgcgctttgtgttttcgtccttcgttttctttcttgttttctttctcttgaccttgattgtgatcttgaataatattttgagtaagaaaaacagatgcatctgacag

SEQ ID NO: 90499 - DNA, 506 bp, Homo sapiens
aacacatttgggatagctggaaattcagcctgtttattctctctacccccttaaagcatggaatggctgatctcctatcacaacccactttttgagaagaaaggatcatacacctgtctgatttggttacctcaaatccagtcctattgcccagtattaccttttgttcatatgtccttgtttggctctttcctagaactgccttccctgggactaaattgtagtgggttttagtttaagataccacattaaattttttaaaacacttttaatatttgtgggtacatagtaggtgtatatcctttacctcttttataagggatcaggtaaataatacatagagaaagtaaggaaggagaaaacaaaggtgagagaagagaatagatggatctcaatgcttcatgattaagaataacttttagtacttcttttcagcttacaaagtgctgtgtatattaccttttgtgaagctcacatttccttgaaataaatggggtggtgtctta

SEQ ID NO: 90500 - DNA, 605 bp, Homo sapiens
cagagcaaacatgcacttctatggaaagctcccataaactttaatgctgtttcttactgcaatccaatacttttaaatcagatgccctcaaatagcagttttccctatataaactagaagtacaataaattttagtatgtggttttttagacatgtgaatacattttgctggtgtgtgtgacattttagaatggtttagtccttctaactaatttgttgagaatgatgcaaatattttaaagaaaaattgtaattaacattggccagaatgagataatagtgataattttgagaatccagaaaaggcttcatcacttcacactcagatcatttgccaatccaaaatgtactctattctttctggtactcttaataagttcttcagtttgattggatggcataacaagcaaactgtcttacgaatgttttttgccctcaagaagctattctaaatgaattagtcttccacaaattaatgaattcatattttaagatacatttgcaaaatgtcctatcattccaatgctaatctgcaacctagttaagaaatgttagcctaacaggaaaaaaattctaatgcgaatgaatgtcatgtttgcacagga

SEQ ID NO: 90501 - DNA, 876 bp, Homo sapiens
catctgtaaagtattgattctcaccttgacaaggtggaggtcatgcgtgtattctcccaggcagaggtctttatcagtacttagccgtcagaatgatctgtaaggtgagtacagccactgatatcttcaactgctcagtaccatctccaaggtcatggccagggcatggtgggtttggatctggaccatctggatctcacacggttcagcccaaatgatttctgtggtgtctgtaatcgtggtgtcttgtgaggactgatgaccccagacgtgcagggccacccttatcccttcccctccccttctcctgtcttctcagcacccccagggttacatggcggtcaggctgagaggcaggggtgacaggatggggtgggagagctccagaagggtcggagacctcactctggtaactgtcattctctagggtctgggaattggtcttggaggtgctgactcatcagaattggagatgcccaggctctctgatgacagatggctctggaggagcacaggaggggtgcacccatcagatgttgatgtctctttccagccgcccttcttcaagggggtactgccaggagcctctggctgaggcacctgcgtcctggtttcaaggcatccagggggtcacttgatgatctgggctgttgcctgctgagcgtgggattcgagattagaggaggtggctctagtctctgagtgtcagcgtcttcctcctggatggagctgactgcacactgccctggtttgctcttggaatctggggcgagtgtgagggtgtgtgtgtgcatgtgtgcccaggtgtttgagcatgtggatgggtgcacgtgtggggtatgtgcatgaggctagtggcgctggtgtgtgtgtgca

SEQ ID NO: 90502 - DNA, 1069 bp, Homo sapiens
  misc_feature (731)..(731): n is a, c, g, or t
  misc_feature (989)..(989): n is a, c, g, or t
  misc_feature (1011)..(1011): n is a, c, g, or t
  misc_feature (1013)..(1013): n is a, c, g, or t
  misc_feature (1015)..(1019): n is a, c, g, or t
  misc_feature (1023)..(1023): n is a, c, g, or t
  misc_feature (1030)..(1031): n is a, c, g, or t
ttccctaatctgactgcctcatcttacattcagcctccttccagagtcactctccgcctgctgtctcgtttgtggcagtggaaatagctaagtaatactgtagatatctggacagccatagacggtgtatatagtatataatatgcactaagtccatcattttctttgtcccttctaacaagcctgtgaggcatttaaggcagagttactgtctccatactgcacgagtaggctccaagaggtgacttgcccaaggcctcacagctgctgtgactggtggagcaggtctttgggcctgcagctggccccactgttgctcaggggcaggtccaggtgctctttccaagtgcagcacaagctctagacctgaaactcttggattttccttcctggtgggttttgtttttttgtttctttttaacaccacgtcctctcgtttccttacatcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcaccagcctggctttccccctcctttaggaatctgattcttcttcctcttcctcctcctcctcttcngtcacatgactctttgtgctcagctccagggttgtttggttgattgatgcttcattgtctacatgcaccaacatatcatgtgactgttcaggtacagtgtgagaagacagcatctcatcccctcttctagaactgatcattgattggagggctaattcttcaaccttgaggcggttcagctggtcgtgcagggctgccttcaaccgcagcagcgtctcctcctccttgcgcagttcctgaagccggctcagcatgttncctggtcacatagccctcggcngntnnnnncccngcctcgnngatgacgccatcgccgccgactcccggaaaccccgctc

SEQ ID NO: 90503 - DNA, 737 bp, Homo sapiens
ttccctaatctgactgcctcatcttacattcagcctccttccagagtcactctccgcctgctgtctcgtttgtggcagtggaaatagctaagtaatactgtagatatctggacagccatagacggtgtatatagtatataatatgcactaagtccatcattttctttgtcccttctaacaagcctgtgaggcatttaaggcagagttactgtctccatactgcacgagtaggctccaagaggtgacttgcccaaggcctcacagctgctgtgactggtggagcaggtctttgggcctgcagctggccccactgttgctcaggggcaggtccaggtgctctttccaagtgcagcacaagctctagacctgaaactcttggattttccttcctggtgggttttgtttttttgtttctttttaacaccacgtcctctcgtttccttacatcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcaccgtgtgggagctttctgcacaacataggacagtctgtctcctttgcgacattaagcaatggtttcccgct

SEQ ID NO: 90504 - DNA, 1395 bp, Homo sapiens
caagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatctcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgataatgtttcttaaatggaaattattttgaatgtcacaaattgatcaaggcattaaaatgtcagatttatctttccccatatccaagtaccaatgctgctataaacgacacgtacagt

SEQ ID NO: 90505 - DNA, 982 bp, Homo sapiens
gtagaggatccgaggtgtggtaggagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgataatgtttcttaaatggaaattattttgaatgtcacaaattgatcaaggcattaaaatgtcagatttatctttccccatatccaagtaccaatgctgctataaacgacacgtacagt

SEQ ID NO: 90506 - DNA, 1085 bp, Homo sapiens
  misc_feature (914)..(914): n is a, c, g, or t
  misc_feature (1084)..(1084): n is a, c, g, or t
caagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaatttngggaagtgggagtttaactgcggggccggccagaggggtgcagtttaggaactgaatggcggactatagggaattcaggggagtgacaccggcggtagtgtataagcaagcctattctttcgtacaagctagcacgagtgtatgtttttttgtgtgtagtaaatatattna

SEQ ID NO: 90507 - DNA, 1449 bp, Homo sapiens
caagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgataatgtttcttaaatggaaattattttgaatgtcacaaattgatcaaggcattaaaatgtcagatttatctttccccatatccaagtaccaatgctgctataaacgacacgtacagt

SEQ ID NO: 90508 - DNA, 1395 bp, Homo sapiens
caagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgataatgtttcttaaatggaaattattttgaatgtcacaaattgatcaaggcattaaaatgtcagatttatctttccccatatccaagtaccaatgctgctataaacgacacgtacagt

SEQ ID NO: 90509 - DNA, 1375 bp, Homo sapiens
tagcatagtagagccgcgtgttaatcggccgaggccactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgataatgtttcttaaatggaaattattttgaatgtcacaaattgatcaaggcattaaaatgtcagatttatctttccccatatccaagtaccaatgctgctataaacgacacgtacagt

SEQ ID NO: 90510 - DNA, 1356 bp, Homo sapiens
caagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaaccctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgataatgtttcttaaatggaaattattttgaatgtcacaaattgatcaaggcattaaaatgtcagatttatctttccccatatccaagtaccaatgctgctataaacgacacgtacagt

SEQ ID NO: 90511 - DNA, 472 bp, Homo sapiens
tctcacattgtttaaatattcattctgttagctttattttaaaagttgtttttaattaggacaggtgcagtggctcatgcttataatcctagtggtttgggaggccaagaatgagaccagcctgggcaatagaggaagacctcatctctacgaaaaattttaaaaaacattagttgggcacgatggtgcgctcctgcagtcctagctacttgggaaactgaggtgggaggattacctgagcccaggagttcaagtctgcagtgagctatgactgcacaactgtactccaacctaggcaacagagcaagaccctgtctcaaaaaaaaaaaaaaaaagacacttgtaaaggtgactatttagtctttaatttcaacaaactgaatttaaatatatcagttactctcagtttagccatcagagattcagactctgttatagctgacccccacagaccacaaaggaaataattttt

SEQ ID NO: 90512 - DNA, 165 bp, Homo sapiens
gaccctcctcaccatcctcataggggtttgaaataatcccacttcacagatggagcatgaggcacattaggtaaatagcaatgtctaagttcactcagcagacggcaaagacggcactcaatactggacaagagcccagatcacccgattccaagcctggtgctg

SEQ ID NO: 90513 - DNA, 447 bp, Homo sapiens
agctgtcagtaataggagtaaatcattcagtcctcatcttgaatgtaaaatatcacctgaatttcaatcaagttgtgagtgcaaagaatttgccagtcatctaatccaagagaggctgtgattagcaagagtcttccaaagcaacttgagagattaggcatgggtaagtcctaaatgatcactcaactgaagccacgtggatttccttggaacatgaaaattcaaataagttacacagcaggctgtggagccataattatcaattcaagaattgataagaacattcaaagtttgagtaagtgtgcatctcattgttttcttgggcccacaaataactctgaaaatatgggttgctgtagaattctctaggctcaggttcaccttgctccgatgacacttcttaacattagacacaggggaagggatgcaatgagtatcacatggaat

SEQ ID NO: 90514 - DNA, 196 bp, Homo sapiens
ttttcttttgtggacactggtgagttccctaatataactttgacttggttatattttcacaatcggtggggattattacagattatcatccttcctctgcatttgaaaaaggagggaggcttcaagtcaggttagttgaccttcctttgttggtcttattatccataacataataaataaattgatgaggatgggc

SEQ ID NO: 90515 - DNA, 395 bp, Homo sapiens
ccattgcctcctggggctctagtcccaagagggtccatttgatatgagtggagggcccgagggtcaaggatcacagcccagctctcccctggtcagtgtccaggctggccccttaaatcaggaacatgacactggcaggcactgatctagcctgtgtcctcagccacagtgattcctggtaccatctgtgcatggccgtctgccctacggatgctgggttgtgaagacccaggcccacctgccattcccattctgaatgccccagagcgcctcctgtcaaggaggtggcctctgggactttactcctcaagcagcaagccaacttccttgtttccgccctcgtcttttcttttaaaagggcatctctttccttttattacaaaagtaataaatgc

SEQ ID NO: 90516 - DNA, 593 bp, Homo sapiens
agcacagtctgactccattccccaggactccacagaaccatctggtactgctagtgctgggtgaacagtgagagcagagtccacaaaacactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90517 - DNA, 1037 bp, Homo sapiens
  misc_feature (920)..(921): n is a, c, g, or t
  misc_feature (942)..(942): n is a, c, g, or t
  misc_feature (944)..(944): n is a, c, g, or t
  misc_feature (946)..(946): n is a, c, g, or t
  misc_feature (951)..(951): n is a, c, g, or t
taggctagtaacgaggcgggggtcaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaataggtctttgttcctctctggctaattggatccnnaaagcaagctggctgggcacncngncgggnggggctggtccggccgaagccaaggttggccggagagaagctcgaaggggcggggccccgggaaagggggccgaatcgagaaaatg

SEQ ID NO: 90518 - DNA, 444 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgaggcaggagaattgcttgaagccagaagtttgagaccagcctgggcaatgtagtgagaccccctgtctctaaaaaatataaataaaaataaaggcatgttcctgaaagactgtcaccttgga

SEQ ID NO: 90519 - DNA, 217 bp, Homo sapiens
ggtctatatatatgttcactttttaaacatttacatttaaaaggtgaacatatatatgaccacttatacttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90520 - DNA, 3237 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90521 - DNA, 2681 bp, Homo sapiens
gactctgaggatccccaactctgccacccacagcatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90522 - DNA, 3194 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatcttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90523 - DNA, 2298 bp, Homo sapiens
tgaggtcgatctgagaggatcccctactttcacacgggaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90524 - DNA, 1969 bp, Homo sapiens
  misc_feature (14)..(14): n is a, c, g, or t
  misc_feature (17)..(17): n is a, c, g, or t
  misc_feature (24)..(24): n is a, c, g, or t
tccggtcggtacgnccnggagtantggatatgtcgaccaggacgtcggtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90525 - DNA, 3641 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaaaaaaaaaaaaaaaaactcgcggcacgagggcaggtcacttaagcccaagagttccagaccagcctggccaagatggtgaaaactggtctttactaaaaatgtaaaaactacccgggcatggtgtcgcatgcctgtaatcccagctactcgggaggctgaggcttgaggatcgcttgaacctgggaggcagaggttgcagtgagccaagatcgcgccactgcactccagcctgagcaacagagtgagactctgtccaaaaaaaaatatatttaaaaaaaacttgtaggggggccccggaccaaattctccctttgggggagccttttacatatcactgggccgcgtttttaaaacgtcttgacttggatggctaaatactaatagggcctcccctatcgcctttt

SEQ ID NO: 90526 - DNA, 3275 bp, Homo sapiens
  misc_feature (3243)..(3246): n is a, c, g, or t
  misc_feature (3248)..(3249): n is a, c, g, or t
  misc_feature (3258)..(3258): n is a, c, g, or t
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaaaaaaannnngnnaaactcctntgccgaattggcacgag

SEQ ID NO: 90527 - DNA, 2317 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaatcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90528 - DNA, 1342 bp, Homo sapiens
acggctagtacgaggcgggtgttaatcggccgaggcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90529 - DNA, 1214 bp, Homo sapiens
ctggtggatggggaatggagaggccctaggtacgagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgctttcaaa

SEQ ID NO: 90530 - DNA, 2752 bp, Homo sapiens
  misc_feature (2635)..(2636): n is a, c, g, or t
  misc_feature (2657)..(2657): n is a, c, g, or t
  misc_feature (2659)..(2659): n is a, c, g, or t
  misc_feature (2661)..(2661): n is a, c, g, or t
  misc_feature (2666)..(2666): n is a, c, g, or t
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaataggtctttgttcctctctggctaattggatccnnaaagcaagctggctgggcacncngncgggnggggctggtccggccgaagccaaggttggccggagagaagctcgaaggggcggggccccgggaaagggggccgaatcgagaaaatg

SEQ ID NO: 90531 - DNA, 2407 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccaccacagcgcatctgcgtagctgccgaactcacgcggcctactcgttcaccgcgtccttctcttgca

SEQ ID NO: 90532 - DNA, 2463 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccccagtgtgataatgtgcacttttcaccccacccaaagtaattgatatttctagacagtgtacactcaaatggtgagctaagcgcaacatacgtacatgcacttagtgggcgacacgcttccgggaaagacatatacgggggaagaactccaggggggcccagg

SEQ ID NO: 90533 - DNA, 2387 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccttgtaactggagctgttgtaactggagctgttgtaactggagctgttgtaactggagctgttgtaactggagctgttgtaactggag

SEQ ID NO: 90534 - DNA, 2224 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagtaggggcagagcttgacctccatctaggtttcttttatctggagaaaaagaaacttttgaactatgtcatgcttcgccctgaaagggcaagctaa

SEQ ID NO: 90535 - DNA, 1178 bp, Homo sapiens
tttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagagtctcctcgaactggtaccgagctcgatcgta

SEQ ID NO: 90536 - DNA, 457 bp, Homo sapiens
gttcagctcgcccagacggaacaggtcagaaggctccaggggagacctcttcagggagatgaaattgctagaacacctgaagtccctacatgtcttaagaagagatttagatgaaagaattgagagttttattagcaacacgtatatagaaaacaaagaaaatgaaatatcaagcttggtttcacttcaaagaaaacacaaagctgtgtcacaaaggaaaagtacgtacaatttaacagtaagggaagggcacatgtggactctgtgctatttttgccactttttcatgtgtctaaaaccatttcaaaagaaaaagcaatcacagtgtatgtggtagacagtctctaaaatggtctccaataacccccacctcctgaaattcacactcttgcattgctcctccccttgagaacatgtggaacctgtgacatgcttctaatcaatggaatatgacaaa

SEQ ID NO: 90537 - DNA, 837 bp, Homo sapiens
taaaattggaagccagagaaaatgtgaaatgagtgtgtacacaaattatcatagaagagggtcaaattgttgcccaaaggcttgtaaactaaggtgcagtttcagagataatctgcttaataaatgtctcaaaggatttttattttcacaaatcctggcccatctcagttgttctaatgtaatgaactattagagaggtttgcagtggtaaaggggactgggtgtgtaggataaacatctgttccagactgactgcttctaggaatgtgacttctgattcactttactttcaaaacttcaagagtaatctctaaagttgtgtatcttttacaatgaaatgtgaacagttcaaatgtattattttctcagtgggaatggattcaggggatttcagttcaatatattctccatcagtgttttgtcacaaggaaactagaactgagaaccaattcacaacaaaaaggtaatccaaatcaagaaataaaatgtaccagttaccttttcaactttgatttactggtcagtcgaaaaagcttttaaaaaataggacagtaaggcctagtgcggtggctcacgcctgtaatcccagcactttgggaggccaaggcgagtggaccacttgaggtcaggagttcgagaccagcctggccaacatggtgaaacctcgtctctactaaaaatacaaaaattagcctggcactttggcgcgtggctgtaatcccagctacttggggggctgaggcacgataattgcttgaactcagaggcagaggttgcagggagctgagattggcaccactgtactccatcctgggtgacacagcgagactctgtcta

SEQ ID NO: 90538 - DNA, 171 bp, Homo sapiens
caacacttatacactgatggtggagactcatgaagactgaaggtctactggaagaagtaatactggtattgtcttgaagatcagaaaagagaaaaggacagggacaatagggagacatttctacctgtaggaaacagtgtgggccaaagtgaggaaatcttaccagagtct

SEQ ID NO: 90539 - DNA, 236 bp, Homo sapiens
gggtggccgccctccagggtgtacagtcacccagctgtggttgggggctgcttcctgtgccatgccatctgctagcctacccacccgtggagggctcctgcatgctgccagccttgggttgtcccctggcctggcaggggacctctatgacattttgagcatgatcagaaaaaggaacttgtggattttcttttagggttagctggtgagcagatgatgccagctagcaagccacc

SEQ ID NO: 90540 - DNA, 234 bp, Homo sapiens
atttagcccaaacaataaaagtacggtgtgagcacttttttggttaataggttatattactataggagaacttacaaggaataatagcccttttctgaaactgcgtagcgaagtcagcagaaagtgagatacagaataaatttgaaaagatgaactttcaagaagcaacagacccacaacctgaaaagtttgaataaaagaaattagatgccattgaggtaattaaatattaat

SEQ ID NO: 90541 - DNA, 434 bp, Homo sapiens
agagggtgtgtgcgtgggaacagctctgggctctgagctccgccgctcctgcctggtgctggtcccgcacccacaggatgagaccccgggcttctttgccctcatgagaggctggaggcagctctcagccccccaggctcctttccctgcaaactagagggtgaccatccctgttctgcacactggcaagcaggtcccccgaggccgtgcgtacttcggtgtccccttaaacccccatcctctgatatcctcggaagcccagctgttcaccaaaactcgcctccccagcggggactacaccctcagaggagggccccgggcatcatcctcctgccctcagcccagcctgcatcccgagtgctttcccataccacagccaccgtcagcgaccttcaaacccctcgacagctgattggcggattggagatgccacc

SEQ ID NO: 90542 - DNA, 241 bp, Homo sapiens
gacagggtttcaccgtgttggtcaggctcatctcgtgatccactcctggtctcaggtgatccgcccacctcggactgccaaagtgctgggattacaggcatgagccaatgcgcccagcccagacaatgttaagagggttttataatcagagaagtaggcccagaaaaatggggacttcccgtctcctaccttgtcctactcgtaaaactagggcgtcacttcaagagtagagggcaacgat

SEQ ID NO: 90543 - DNA, 291 bp, Homo sapiens
ttggacttgatcaattatttcaaagtcaaaacaatgactaataaattaactgatcaattttaaaagttttatgtttcaaagagcaacatcaagaaagtgaaaagacaaaccacagaatggaagaaaatttttcttatatatctgatagggtacttttgtatagaatatatcaagaatgcatgcaacttaacaataaaaagacagtggcccaatttaaaaatgggcaaagggtctgaatagagatttctacaaagaagattaactaatggacaatagacactgaaaaagata

SEQ ID NO: 90544 - DNA, 1962 bp, Homo sapiens
gcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaagattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaaggagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctcagact

SEQ ID NO: 90545 - DNA, 2180 bp, Homo sapiens
gcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaaggccttcaccatggccgagtcccccggctgctgctccgtctgggcccgctgcctccactgcctgtatagctgccactggaggaaatgccccagagagaggatgcaaaccagcaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaaggagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctcagact

SEQ ID NO: 90546 - DNA, 532 bp, Homo sapiens
cacgaatgtagcctctgtattcccaacccgaatcacagcccacagcagtgacttctcctggactgaactgaagagactcaatgctggatcctggttcctagaggtgaggacagcctctgcaaagaggcagccatctgcagggacactcagagagggcagagttcattctgttgataagcatttgctcagccctgtgctaggcaataagaacatagtctgtgctctcaagtcacttccacctagtagagagcctaggcagcagacgattcaggaaacccagagcaataaaaacattttcctgcctgggagagaatcaggagtggattcatacaggagaggatgaaagtcttcttctaagatgcacaaagcagggaacaggaactccttcagagggaagaggacacgtaaagcccagaagtctgaaaaagggtgtttccaggaataaaatgtggctgaatgtaactgagagagacaattcatgggagtggtagggagcagaggcttggccttgaagagctccgaatgcctggcc

SEQ ID NO: 90547 - DNA, 1477 bp, Homo sapiens
ccaccacgccctgcccatttatgttcattttttttagagaattctcctcctcccatttatgaagctagatttttttttaatttcaccaaaatttgttgacgtcccttgatttgctgatagggacaataattaaatattttccacttgtttttataaaaactgtaatggtgatttgtttaacagatgttgacttagcaccttctctctttttttttttttttttttgagttggagtcttgctctgtcacccagctggagtgcagtggcacgatttcggctcactgcaacctccgcctcccaggttcaggcgcttctcctgcctcagcctcccaaatagttgggattacaggtgcatgccgccacgcctagctaatgttttttgtatcttagtagagatggtgtttcaccttgttgcccatgccgctcttgaactccttggcctcccaaagtgttaggattacaggcgtgagccactgtgcctggccccaatttagcaccttactgggtgctgaggctgtgagccatagtagaatgcatgtgatccagggccttgctgaattcatggtctaatagggagcctgacacgcaggcacagagcggagggcagtggctgtggctcccagggacaccaccctgtccagagttcagtggcagcttctcattaaaaaaagctttgagacctgaattggagtctgtctggcaggcaggtggggatggaggggaggagtgtatcctaggctgatgagatggtgtgtttttcatccggcaaccaactggtctccttcactgtctccagcaccccgcacaatactgtgtgccaggtgctcagtaattatttatcaagcgcataagagcacagcacatccagggacggaagttccaaagggctaggagagtggttagacctggaagccaaaaggtttacagtctggataaagagcttttaccttgaggccgggcacagtggcttatgcctgtggtcccaccactttgggaggccagggcgggcggatcacttgaggtcaggagtttgagaccagcctggccagcatggtgaaaccttgtctctactaaacatataaaaattaggcttggtggcgcacacctgtattctcagctactcattaggctgaggcacaaggatcgcttgaatctgggaggcggaggttgcagtgacccaagatcaccctagcctgggtgacagtgtgagactccaaaaaaaaagaaaaaaatgaacttttacctcgagagctccaggaagccctgaaagagttttaaggagattgatctgatggggatcattacttggtagttgagcgtagagtgctcaggggagggaggggactctagtcagttggcaaagctgctgtagaagaggaaaggggtctggaccaggttgacgattgataagacctggtgaccgaagggaaggcgagagtggcgagaaagatgtaaatgaccacaggtttccgtctgc

SEQ ID NO: 90548 - DNA, 1424 bp, Homo sapiens
ccaccacgccctgcccatttatgttcattttttttagagaattctcctcctcccatttatgaagctagatttttttttaatttcaccaaaatttgttgacgtcccttgatttgctgatagggacaataattaaatattttccacttgtttttataaaaactgtaatggtgatttgtttaacagatgttgacttagcaccttctctctttttttttttttttttttgagttggagtcttgctctgtcacccagctggagtgcagtggcacgatttcggctcactgcaacctccgcctcccaggttcaggcgcttctcctgcctcagcctcccaaatagttgggattacaggtgcatgccgccacgcctagctaatgttttttgtatcttagtagagatggtgtttcaccttgttgcccatgccgctcttgaactccttggcctcccaaagtgttaggattacaggcgtgagccactgtgcctggccccaatttagcaccttactgggtgctgaggctgtgagccatagtagaatgcatgtgatccagggccttgctgaattcatggtctaatagggagcctgacacgcaggcacagagcggagggcagtggctgtggctcccagggacaccaccctgtccagagttcagtggcagcttctcattaaaaaaagctttgagacctgaattggagtctgtctggcaggcaggtggggatggaggggaggagtgtatcctaggctgatgagatggtgtgtttttcatccggcaaccaactggtctccttcactgtctccagcaccccgcacaatactgtgtgccaggtgctcagtaattatttatcaagcgcataagagcacagcacatccagggacggaagttccaaagggctaggagagtggttagacctggaagccaaaaggtttacagtctggataaagagcttttaccttgaggccgggcacagtggcttatgcctgtggtcccaccactttgggaggccagggcgggcggatcacttgaggtcaggagtttgagaccagcctggccagcatggtgaaaccttgtctctactaaacatatagcacaaggatcgcttgaatctgggaggcggaggttgcagtgacccaagatcaccctagcctgggtgacagtgtgagactccaaaaaaaaagaaaaaaatgaacttttacctcgagagctccaggaagccctgaaagagttttaaggagattgatctgatggggatcattacttggtagttgagcgtagagtgctcaggggagggaggggactctagtcagttggcaaagctgctgtagaagaggaaaggggtctggaccaggttgacgattgataagacctggtgaccgaagggaaggcgagagtggcgagaaagatgtaaatgaccacaggtttccgtctgc

SEQ ID NO: 90549 - DNA, 3136 bp, Homo sapiens
acccctcctcttcctcctcagcctactcaacgtgaagatgatgaggacgaagacctttaggatgatccacttccacttaatgaatagcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttgaagcccggggtgccttgtggtggatcgggtgggggctggggcggcaggtgtcctcgtcatctcacttgggggcctgcatgtctcttggagggtccaggataagtcgtgagcaacacgggcgagggggtgcaccgggggcatgacgtggtgggctacgtattgttcacgtcagtaagggaattgtggccacgatgacgggatgtgaggagggcccacgtctgggtagaggtggtcggggcagcctcctagaagtgatatttaagctgaaacatgaaggagaatgggcctcctttgctgaaagtttgccgagag

SEQ ID NO: 90550 - DNA, 3115 bp, Homo sapiens
acccctcctcttcctcctcagcctactcaacgtgaagatgatgaggacgaagacctttaggatgatccacttccacttaatgaatagcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaaggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttgaagcccggggtgccttgtggtggatcgggtgggggctggggcggcaggtgtcctcgtcatctcacttgggggcctgcatgtctcttggagggtccaggataagtcgtgagcaacacgggcgagggggtgcaccgggggcatgacgtggtgggctacgtattgttcacgtcagtaagggaattgtggccacgatgacgggatgtgaggagggcccacgtctgggtagaggtggtcggggcagcctcctagaagtgatatttaagctgaaacatgaaggagaatgggcctcctttgctgaaagtttgccgagag

SEQ ID NO: 90551 - DNA, 3253 bp, Homo sapiens
acccctcctcttcctcctcagcctactcaacgtgaagatgatgaggacgaagacctttaggatgatccacttccacttaatgaatagcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagtagagacggggtttcatcatgttcgccaggatggtctcaatctcctgacctcgtgatccgcccgcctcggccttccaaagtgctgggattacaggcgtgagccaccgtgcctggcctagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttgaagcccggggtgccttgtggtggatcgggtgggggctggggcggcaggtgtcctcgtcatctcacttgggggcctgcatgtctcttggagggtccaggataagtcgtgagcaacacgggcgagggggtgcaccgggggcatgacgtggtgggctacgtattgttcacgtcagtaagggaattgtggccacgatgacgggatgtgaggagggcccacgtctgggtagaggtggtcggggcagcctcctagaagtgatatttaagctgaaacatgaaggagaatgggcctcctttgctgaaagtttgccgagag

SEQ ID NO: 90552 - DNA, 1011 bp, Homo sapiens
acccctcctcttcctcctcagcctactcaacgtgaagatgatgaggacgaagacctttaggatgatccacttccacttaatgaatagcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttga

SEQ ID NO: 90553 - DNA, 330 bp, Homo sapiens
gaacaaatagcgaaggatttgctttcaggggaagaagaggaagagacgcaatcatctgctgacgacctcaccccgtccgtgacctcccacgaggcctccgacctcttccctaaccggagtggatgtaggtgactctgtccccatactccaccgcagccaggccccctgccaggcagtcgtgatgcttgatgaagggtccttgggctgatgcaggccaagaactcatcacagatgagggcgtctgcctggcgggaagcgtcagtagccctgggggtgctttgttctcctccacgctggccagtgagcctggactctcagagcgatttggtt

SEQ ID NO: 90554 - DNA, 2825 bp, Homo sapiens
acccctcctcttcctcctcagcctactcaacgtgaagatgatgaggacgaagacctttaggatgatccacttccacttaatgaatagcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttga

SEQ ID NO: 90555 - DNA, 1204 bp, Homo sapiens
acccctcctcttcctcctcagcctactcaacgtgaagatgatgaggacgaagacctttaggatgatccacttccacttaatgaatagcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagtagagacggggtttcatcatgttcgccaggatggtctcaatctcctgacctcgtgatccgcccgcctcggccttccaaagtgctgggattacaggcgtgagccaccgtgcctggcctagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagacaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttga

SEQ ID NO: 90556 - DNA, 788 bp, Homo sapiens
gcgctcgtgccgaattcggcacgaggcgctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccagagaagagcagttagtaacttgtacaaaacatcaaccttttgagcaaataatagccaataacttttaaa

SEQ ID NO: 90557 - DNA, 961 bp, Homo sapiens
gcgctcgtgccgaattcggcacgaggcgctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccagatttggctacacaatttcaaaacctgcatttgtgttcgtgaggcatctcataacactgtgtgcattgtcatgggctaaaaaggaagcagagaaacactttggacaatcgaggagggaggagccaagatggccgaataggaacagctccggtctacagctcccagcgtgagcgacgcagaagacgggtgatttctgcatttccatctgaggtaccgggttcatctcactacggagtgcgaga

SEQ ID NO: 90558 - DNA, 1023 bp, Homo sapiens
aggcgcctgccaccacgcctggctaatttttgcatttttggtagagacggggtttcaccttgttgatcaggctgatctccaactcctgacctcaggtcatccacccacctccgccaccgtgcccggccgaaatttgtgattttataactaagaatttttagttaagaacattatcagtaaagacaacgtaatcccaccctggagagtttattgggagcccaggaatattcatttttaatacacacacacacacacacacacacacacacactgatcagagtaacgggagtttctctcaggagtcatactccatgagcctggacccagtggttctttatgtggaaacaaatttcacctataggtaacctggtaactgctattttcttctgtgtgctctgtcaacaaaggtatcagtggcttgcaggagatgcctttaatactcagagcattctatctccccctatctggtttagaaggaaggccttcattagttaccttttgagaagttactagaactctctattagagacttaccctcctgacctgataaaaagggatacccatgtctctattaacagctttatctctttctacagttttgggtatttgataaggttaaggcaaaattttagttatgcttaaggaggagttcttttttcacaattacagagaaaattttggtttgttgaagattgcagaaacagcaatggtaatgtaagacagttttggcctttaatttttttcttgaaactctacagtatactacaatagtgaaggaaactattatcatgagagatccttctgaataggatgtctttctgagttccactattcagttacaaaactccttaatgcttaaaattcattatgaaaattagatttattttaaatactttcaagtgtatacatttttatttcataatttttattgtcttttaactaaagcatttagttcatttatatttactgtgtaccttttatatttaataaatatatttacttattaaaagattaccactgata

SEQ ID NO: 90559 - DNA, 1005 bp, Homo sapiens
ggtaccctggatatagtgaggagttctgctgaaagattgcacagtctgaagaggctggaacaaaaatgaccaggagagagacacagcctgtctccagagaaattgttcctgtggtttcccaaagacaaaaaagtgatggttttaaacaatgggaaaaatgggaatgaaaacaggtacttggggaaactgaatggatcctatcaaacaatacagggtcacaagcacgcacacacacacacacacacacacacactgatcagagtaacgggagtttctctcaggagtcatactccatgagcctggacccagtggttctttatgtggaaacaaatttcacctataggtaacctggtaactgctattttcttctgtgtgctctgtcaacaaaggtatcagtggcttgcaggagatgcctttaatactcagagcattctatctccccctatctggtttagaaggaaggccttcattagttaccttttgagaagttactagaactctctattagagacttaccctcctgacctgataaaaagggatacccatgtctctattaacagctttatctctttctacagttttgggtatttgataaggttaaggcaaaattttagttatgcttaaggaggagttcttttttcacaattacagagaaaattttggtttgttgaagattgcagaaacagcaatggtaatgtaagacagttttggcctttaatttttttcttgaaactctacagtatactacaatagtgaaggaaactattatcatgagagatccttctgaataggatgtctttctgagttccactattcagttacaaaactccttaatgcttaaaattcattatgaaaattagatttattttaaatactttcaagtgtatacatttttatttcataatttttattgtcttttaactaaagcatttagttcatttatatttactgtgtaccttttatatttaataaatatatttacttattaaaagattaccactgata

SEQ ID NO: 90560 - DNA, 322 bp, Homo sapiens
aaaaaaacaaacaaacaaaaaaaataaaaacaaacaacaaaaacctgacccattccacagggcttccctccgtctgcaattggaatgcacccctgggcattgttttgccatggcttagggaaacccctccacatggtgaattaatgcaagacggactagataagagcagttaggaactcaatgttttcacatagatggcaatcttttgcttaaagcctaagacccacagtgacttaacaacaagaaaagagggataaaaggttatcaacgccgcccacatgtgcagtgtgttttggaaaacttgatcctattgtgtacaaac

SEQ ID NO: 90561 - DNA, 363 bp, Homo sapiens
ctttcggcattttaaaaatggcaagtcttacagactccataaccactaccactgctaccaccacaaccacagagagagccagatctgaaaatacaggaactgatctgaaaatataggaactgaaaattcagtcagtcaaatttggagttgatttgggcagaggataggagatgaacaggctgaggatgtttctccagccaagacaagagtgcagcattttttttagttgaaattaaaaagaaaatgcagagtgtactttgtcccactcatttaccctaacgatcttcagcgtgtctctgtttctaaggaagtggagggcccaagtctctgattcatttccggaatgccacatagcacccttgg

SEQ ID NO: 90562 - DNA, 459 bp, Homo sapiens
tttaacacttggccaaggtcacacagctggtaagtggcagagatgaaccctgtgtgatcccaaagtccatgtccttatctttttaaaattgaggcgtgacttacatgcaatgaaacgcatagatctaaagtgttaaggttaagcatttttataaatgtgtgcaccctagtaatccacattctatcaagatacagaacatttccatcccttcagaaaattcccttttacttttcccagtccatcccactacttaccccaaaaagcaataacttctggtttccatcatgatagattagttttgcctgttttctaaaatgtcatgtatatatggtcatacaatatgtgctctttcgtgcttgtttcagcatgatgtttgagactcatctatgtgttgctggtgttagtagttcatttctttttattgttgaggagtattcctttgaccgtaccatagtttat

SEQ ID NO: 90563 - DNA, 132 bp, Homo sapiens
tgtcactcaagttggagtgcagtgatccgatcatggctcactccagtcccgacctcctgggtctaagtaatcttcttgtctcagcctccctgaatagctaggactacaggaacacacccaccattaccctgg

SEQ ID NO: 90564 - DNA, 296 bp, Homo sapiens
ggctggacctatagttgcttttctgagggttctcttcaatctccagttaaactcccctcagtctcttttttcaaaggcatcactatggttttgagtgttttctaggacctttagaaataataggacccagacagttgtaaccatataaactgacataagtacgaatctactttaatgcatattaaccgacatcacaaggaccactcttttccctcttttctctagtgtctcttaaaaatctgttatactaaagctcttttttcctgatccatggtttagttccatatttgaaatca

SEQ ID NO: 90565 - DNA, 413 bp, Homo sapiens
gttggatgtgatacagtatgaagcctggctaattttgtcatctaaaggtattatgtgtaaggaataaacacatttccatttattaagaattcaagatgcttggttaagtttattcatttttttatttttatttttttactttttagaggtgaggtctctctgtgttgcccaggcaggtcttgaactcctggcctcaaatgatcctcacaccttggcctcccaaagtactgggataacaggcattagccactggtgcctagcctttttgtcttagttgattttgttatagtatttaagaatttcaacagggagttgaaataagtagattttgggttaacttaccagtttctagataaataattgatacatgtagtcaaaccctgtgaccttaaaacttttctactatatttaaa

SEQ ID NO: 90566 - DNA, 264 bp, Homo sapiens
ccctccctcctgatgaagaactgagagaaatataacaaaggctaatgtattccttgaatgagtaaatgttagcattttcaaagatgtaaacttggatctcaggtctgtcactagctttgtgactttaggcaagctactatcttctctgcctcagttttcttgtcttaaaaatgggacaatagtagttcctgttttcatagaggtgttataagtgaaatatgatactgttagcacagtgcctgggatataagcccataatcagcg

SEQ ID NO: 90567 - DNA, 271 bp, Homo sapiens
tccctctctctacccatcagtgcacctcattttccgatatatttcagtgtaaattgcaggtatccgtatactttgtccctaacatgaagcacagacattcattttccccaaagcaattagacttcccccactgaattcactaacaatttcagaactacatctgtggggcggggaccacttgcaaaccataagatcataagggtagggccctgatcctattcaatgggtgcacttataagagaaggaagagagacctgggctctttccacca

SEQ ID NO: 90568 - DNA, 673 bp, Homo sapiens
cctcccgggttcaagcgattctcctgccccagcctcccgagtagctgggattacaggcgcgtaccaccacaccaggctaatttttgtatttttagtagagacagggtttccccatattggccaggccggtctcgaactcctgacctcaggtgatctacccacctcagcctcccaatgtgctgggattacaggcatgagccattacgcctggccgcctcagcgttcttgaaagcttcctgggcttccttgagggtcggagagggccactgagtaatgtgtgccaggagtccccccggggagcacacatttcagattctgcttgtgagagtcagtggcgggcttctagaaggttcctaaggcagatctcttttggttaatgatgggctatgttttagtgagacctgctaaggccatagttccggaggcttctaggtggtagaagcaagggagggaggagttggaagagaactttccaaacttgagtgtgctgcgcatcacgtggggattgcctcggaggttctgagcaggggctggggcagggtgagatgctgcattttgaacacttttgcacatgatgcgatgcctctggattgtagaccatactttgagtgcagtgggccaggagatcatccaacctgaccctctccccttcattcattcaggagccaggctg

SEQ ID NO: 90569 - DNA, 441 bp, Homo sapiens
aaatgatgatgctccagataatctctttagaaaggtacaactatttctcgagtttaaacaaaatgttaactcgtacagtaaaaatatcaggacatcagagtatacctgaatgaatgtattggaagtacttaccaggtataaaattctatgcttcgggcatggtggcttaagcaagcatggatggaatcttagcactttggaaggccgaggcaggcagatcacctgagatcaggagttgagaccatcctggccaacatagtgaaaccccatctctactaaaaatacaaaaattagccagacatggtggctcatgcctgtaatcccagctactcaggaggttgaggcaagagaatcatttgcacccaggatgcagaggttgcagtgagacaaggtctcgccaccgcactacagcctgagcagcagaaccagactctatctcaa

SEQ ID NO: 90570 - DNA, 182 bp, Homo sapiens
gtagtggggttggtgggcaggttatatgtttaagaagcattggtataagaacaggtggttatggccaggcacggtggctcatgcctgtaatcccagcactttgggaggccaaggcaggtggatcatctgaggtcaggagttcaagacaagcctggcccacatggcaaaaccctgtctctact

SEQ ID NO: 90571 - DNA, 440 bp, Homo sapiens
agagtgagaccctgtctaaataaaaataaaattgggagatacctttaagatagctctaaagtgaaaatcatagaattctctctaatggaagggtttatataatagttatctttcattcagtgattaagtcaggctttgtacttttcatctactactatttaatccttttaacaactcaatgatataggtagtaatattattcttcaccatttcacaagggaggcatagaaagattaatttatctaacttcacacagccattaagtggcaggaccaccagtatttgaaccggtcagtctggcctggagcacatgatcctgacctgtgcactgtatggctggagcctaatctggtagcccctttcgcgatacctagctggcacagctaaaccattttcttctctgccatccacattcacatcattccacttaccaggtgaca

SEQ ID NO: 90572 - DNA, 859 bp, Homo sapiens
gaaaaactgttccccaaaaattaacacaccaaactggcccatgattaaataggacaatttcaagtttaagggtataaaagcaatagaacaaagttaataagtatctcccatacctaccccatgtacagcctcctgaaagacaccaaaaataagaaatggaggaagtcttcgttataacaagcaatttcaggacaagagttatgcctcataaatcaaatgtgtaatggaccaagaaatatggctatagatcttacctctataggctaagaatatgaagacccaaatgcaaatagttaatactaaaatgtcaagcttattaactgttaaacacaaaatgtactaccttaatttgcttaaattagcaaaacatgaggtgaaaatgaaaatggaaaacttcacacagttactggtgtcctctggaacctctccagaaagcaatgatgaagtgtgtaaaaaataatcccaagaatataaacagaaaacatacaggtatgttcatggtttacttatatccagcaagaacctaggtaaaattacagtgaatcctcaaactaacaaaaattatttttccaagattattaaagtggtgaaacactcagatgaccatgttgtgtgatgaaaggcctacaaggtaatacataaaagggctcccaatatctttgaaaataaacatgtggctggagccagctgctcatgcctgtaatcccagcacttcaggaggccaaggcaggaggatcacttgagcccaaggggtttgagaccagcctgggcaacatagcgagaccccatctccacaaaaaaatttaattagccaagcatgatgccatacacctgtactctcagctacgcaggaggatga

SEQ ID NO: 90573 - DNA, 332 bp, Homo sapiens
tagcaagacttcatctcaaaaaaaaattatcacaataatcattttcacataagtatacctataggagaaaacctagaacatatatatagcaggcttgtccaacctgtggccctacacaaatctgtaaactttcttaaaacaatatgagatttttttgtgatttttttcttttagctcatcagctattgctagcattagtgtattttatgtgtggcccaaggcgattcttcttcttccaatgtggcgcatgtaggccaaaagattggacatcgttgatatacacgttaacaggtgccatccttggatggcaggattatagagattgctacatg

SEQ ID NO: 90574 - DNA, 739 bp, Homo sapiens
  misc_feature (136)..(136): n is a, c, g, or t
  misc_feature (150)..(150): n is a, c, g, or t
  misc_feature (170)..(170): n is a, c, g, or t
cctcgcaagggtccgttacataggtatacatgtgccatggtggtttgctgaacccatcaacccgtcatcttcaaagataaggccttcagtatatcaagttcagtggttcaaagaaacatcctcaagaaactaaganacaacacaagattntttctgatgaaatgcttaantataaggaaaatgatggaagacacagaagagcagcagaattgggtagaagactactacagatgccagatcgccacttctgaaagaaaggcttacgacaactggctctgtgtttaagcctcgcagagggagatgcaagagaagaaggctgcctacaagcagcacagataggaaatgattgaaaaacagagagtgctggagagacacattagtcaggagccagctagtggacaaccaggcatagagaatcatccccaaagaggtcaatatggctttgggaaggcccctttttcaggatgccctacttgctctactgcatggctggctcttcaggaccatttgtgggctgccagacacctcctctgcctgggtggcctctgggaacacgaccactgcctccatgcacaccacttggacaagctgaaatttgaagaggcccctgagctgtgacagccatgctgtggctcctacataacttggaaaagtatccaatacattttacgctgcctgcccagtgctgcctcatctgtctctaatcttctgtagtgtttcccctaataaaggtttgcag

SEQ ID NO: 90575 - DNA, 124 bp, Homo sapiens
tctcccacctcagcctcctgagtagctgggactacaggggcacaccaccatgcccagctaattttttaaaacattttttatagaaatggggtactgttctgtcaccaaggctcatcttgaactc

SEQ ID NO: 90576 - DNA, 296 bp, Homo sapiens
tccttaagcaaatgaattttcttgtcactacttctgcctgtccgctgctgtgttcccagttagcgagtttcaggattctggcatcatctttgagtccttccttaaatccagtggcctgaaccttcctaaattcttgaatactgtcatttcctatgcctgccctatttaggacctgactgcctcactcctggtcttttgacccctagtctctccccattctctccccaaatgctgactgaatacccaccacatgccaccctggtccatcctgtatatactgacatgcggagcagagc

SEQ ID NO: 90577 - DNA, 487 bp, Homo sapiens
ggtattatgttcgtctttgtagcaagtcctattgcctttctttaatttttgatcctgttgatcagtcttcctgtaatgccattttggcccctgcaattccccatagtacatgttttcttaagctctaaatctgtttccttgctgccttcacttgaccctcttatttttcctgtttgcttagcgatctctttaatctcaaaatgtctatatcagtgagaattcataccctatctgcccctgattatatgattgattttattgtttctatattatgtcaaattgtttctgcagtaaaataattggagatgccttctgtctggacacattaattcctctggttaatgcatacatatacatacagaaactatcatttacctttttgtgttttgaaacttgtggtataacttagcacactgcatcttgtccttttcacttaatacattatcctgcagctcagaaaacagctgaagttcactctttttttagt

SEQ ID NO: 90578 - DNA, 236 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(7): n is a, c, g, or t
  misc_feature (9)..(12): n is a, c, g, or t
  misc_feature (54)..(54): n is a, c, g, or t
  misc_feature (81)..(81): n is a, c, g, or t
  misc_feature (96)..(96): n is a, c, g, or t
  misc_feature (144)..(144): n is a, c, g, or t
  misc_feature (165)..(166): n is a, c, g, or t
  misc_feature (187)..(187): n is a, c, g, or t
  misc_feature (191)..(191): n is a, c, g, or t
  misc_feature (213)..(214): n is a, c, g, or t
ncnangngnnnngttaaagtgtttaaatctctcttgaacaaacacagccacagncatgctattctatctatattttcactnaaaagatacaccagnagacctattttaggaggtcatattgagccaaaaaatgaactgagcaantgacatttccaaactcttttnntgctcaaaaataatatgttcncctntgatattaaatgcagatatcanntctggattagctatttactgag

SEQ ID NO: 90579 - DNA, 199 bp, Homo sapiens
aacttgcttattctctgacccaatgacaaaggaaaatgaaagcattaaattcagaaccctagccaaaacaattagggtgaagaaaatggaaactttcaaattcactagtatccagcttaacattgttgcaatatcattaatagtacaagccatacaaatttatgtataagtaatccatttggactatacatttgaaatt

SEQ ID NO: 90580 - DNA, 403 bp, Homo sapiens
agaggaaatgcagccaaatgcttataattgcagttgtgggactcacacagactcacagccacctttgagtcctggctctgcccttggtggccggggacctttggacagggctaacccacaggatggacctgctgatcccagtagaccacaaagtggagctaaagtgtacaacctaagagcacaggggacctgcattcgacccaagaaagagattgtagttttccaacagagttctcgggggaggccagactccaaatagctgttcagacccagacaaatttgtggactaatagggagagaggaaaccactccacagaaaagatcaatgttttcaccatccaagtctctctgcaatggaaaaagcagctctgtgtgcaatagagctcccccatccttcaagaat

SEQ ID NO: 90581 - DNA, 373 bp, Homo sapiens
gggaagcccttgaaatagtcagaaagactgcccattaattggtctgcccaaacatgtgaattgtttgcattaaatcaagccttaaggcacttgcagaacaagaagagactatttacactgattccaagtacgccttcggggtagctcacacctttggaaaaatttggactgaatgaggtcttattaacaaaggccaagacctggtccacaaagaattaatcactcaggtattagataacttccagttaccagaagaaatagctattgtccatgttccaagacatcagaaaggtatcgcttttgaaggccaagggaataaccttgcatatcaaatagccaaacaaactgccacttcctctgaaatgcctgtttt

SEQ ID NO: 90582 - DNA, 234 bp, Homo sapiens
gggtctccctacatctggctgtcctcttttcagtcacattgactagagaaatgatgcccctggtcacaacagagtcctctgagaacacctgtcactcaaaaccctacaatattttgtccctttattcttacatcctatattcttattttatcaataagatttcaactgaaggagagaaggggctctatcacagggaataagatatatatgcatatacacacacacagtatataa

SEQ ID NO: 90583 - DNA, 302 bp, Homo sapiens
ctagaactgggttatcctttttaggggtatcagtctggtccatcaaaatcatcattggagtggagtttatgatattaaatataacatatatatgtgtatctatctatatctatctatctatgtatctaatctgtctacccatccagagaactgacagatttctaactgatttctgatttcccatgtagttgggactcagatattctttggggaaagaactagagaatttcagaggcagattattgaagatgcagttgaaattccagaaaataagcagatcttttgcgtgaaatgctgagtag

SEQ ID NO: 90584 - DNA, 114 bp, Homo sapiens
tttgtgttacttacgtaaattttccattaggttagactcctaagaataaactcaatggagcaaagggtatgaacatttaaacttttggaagatgagttgtcttcactgtccagg

SEQ ID NO: 90585 - DNA, 388 bp, Homo sapiens
tgactgtggaacacaccttagtttctcagaccagggtggatggctgccaccttgccccaccctagaagctgtgggcacacacctggtcttccctgcttctttgcacggaacactgccagggtggaaggtgaccgtggaatgggagcctttccttgccactctgacggaccctgcctggtgtggagggcggtggcaggcacagccctaggacaaggaggctgaggaggctggggcactaggtgggaggaattaagccactgagaagtcctcccttccagggaggtagtgggaagtaggactgtgctccaagcccgggcacagcctccatgtcccatcaggcttcgccacaaaacacacattcaaagataagatgataagaatttcaagc

SEQ ID NO: 90586 - DNA, 176 bp, Homo sapiens
tgagacggagtctcactctgttgcccaggctggagtgcagtggcatgatcttggctcactgcaagcgtgtgagacaaatttttaatttaaaaagtaggatgtggttatgagtatatagaataaaggaaaataatcacagaataattcaaaggatctttcaatcaagatgctttctg

SEQ ID NO: 90587 - DNA, 692 bp, Homo sapiens
catctcacagatgctgagggcgagaatggcagcagccatacactgcctgagtttagagaggactgctgggggtgcatgtgcaggtgccacgttaccacctagaacacactgtctcatgctgtgagccagggctttttaggcacacaatgatgcagttcctgctgaaattctgaaggcagaggctacacctgagcagctcctaccggctcagtggcatttagcccatgggacgcggggggacactgctttccaaagttgagggtctgcctcctctatgcagaaacaacaggaagggataaggagtggggcttgagtgaagacagaagcagcaattctgttgagatacatatgagtgcagggtggatgctggtgtcagccatagagggccccaatggctggtgctggttagtcatgtatgcaggtccttctttttcctcctacctgttgctaatcccttggctttgccattgggtagcatttgatagggactaaagggaggtgagtggtgtccatcacgtgcacacatcataatgaagagagggagattaaaaagtcgagtttcataaggcaggcttgcttctgacttttctcagagggcagcaccccttccttttgataattctgaagataagcagaacagactaggtttcacagtccacttatctactaagttaggccttcgcaatgaaaag

SEQ ID NO: 90588 - DNA, 1529 bp, Homo sapiens
agccaaggctggcgggtcacctgaggtcaggagttcaagaccagcctggccaacatggtgaaaccccatctctactaaaaatacaaaagttatcctggtgtggtggcactcacatgtagtctcagctacttgggaggctgaggcaggagaatcacttgaacctgggaggcggaggttgcagtgagccaagatggcaccactgcactctagcctgggtgacagagtgagactcagtctcaaaaaaaaataaaaataaaaaacagcaaccaaaaaaaatgcaaataaaacttctctgaggaaagtgtgaaaacttgagccatcaagtggcaaaacctggtacaagaacgcttttgaaaagctaccttcggtgaagccttgatcctgggaaatggcttcgaaaaacttgagaacatagtttaaatattctgttactcaagaatagtgaaagaaatatatttcctattgtgggaaattatttctgagtagtttcggtagagcataaaaatgtattattaggggatcaaaataacgttttatgtcatttagatacaaagacttggcatgcttctgaaataatttataaatggacatatctgcgtgtcctcttgtggtgttgtgatacatactggttttcatccaccacggttcctggctcataacacccataaccccattaccgtgttttgttataatatagggtacgttaggtctcagaaaataatctctgatcttctcctgctctccttacacgtgtcccaaggcaagattctgatctttacccagctttctgattgtaggtcttgagatcctctctagagagagggtgttggccctataccccggggaagggaagtaaggtttcctatatgaagcttttataaaaacccaggagggccaggcgcggtgggctcacgcctgtaatcccagcattttgggaggctgggggcgagcaaatcacaagtttaggagtttgagaccagcctggccatcgtggtgaaaccccatctctactaaaaatacaaaaaaaattagctgggtttagtggtgggggcctataatcccagctactcaggaggctgaggctggagaattgctcaaacccgggaggcagaggttacagtgaggcgagattgcaccactgcactccagcctgggggacagagtgagattctgtctttaaaaaaaaaaaaaaaaaacgcaggaggactgggttcagagagcttccagatagttgaacacacctggagggtggcgcccccagagagggtatggaagcccagtgcccttacgcatttctttatctgtactttttataataaaccggtaaacataagtgtttccccaagttttgtgagatgctccagcaaattaatagaactcaaggagggggtcttgggaaccccagcttgaagtgtcagtcagaagttctggaggcccagacttacagttggagtctgaagaaggagagagcagttttggggactgagcccccatcttgtggaatatgacactgtatccaggtagacagt

SEQ ID NO: 90589 - DNA, 275 bp, Homo sapiens
tgcctcagcctcccgagtagctgggactacaggcgcatgccaccacacccagctaatttttgtatttttagtagagacggggtttcactatgttggccaggatggtcttgatctcttgacctcatgatccgcccgccttaacctcctcaagtgctgggattacaggtgtgagccaccacacccggcctcaatgtattcatttttaaagaggttcttagacattaatatttcatccagttctcagctggtcttgtaaaccaacagcggttatattt

SEQ ID NO: 90590 - DNA, 337 bp, Homo sapiens
tctctggaatgggattttcagtatgtgtgaggctcgctgcccaataggttgacagtatatactcatttgtaaatgggaagtttgtatttacctgataagttttcaatgagaatattagccaaaacattcctggtattttatggtaatagttggatgtgctgggcttctgtattctgaggccaaattgtacctgagaatatgccaggatgggaccatcttcaagaaagacaatagtgcaagaaaccaaccattgctctctctatgtgttttttaaagtaaaatattttatctacttttcattttggcccttcggatcagtttcaggtttagaccttct

SEQ ID NO: 90591 - DNA, 1027 bp, Homo sapiens
agatgttttgggctattttatgagaatatttactcataccacttggtataggttgttccaggctgtaaaattcaatgctgggtctgtgaatttatctgtttggcataatgcttctcttcacagtagctactcagtgtgtaaccaactaaataaaacagctataaattctttatgcaacatgtggtctgaaaaagtttgaggctttcctcatttgtgtcagattttccctgtcctgtattcagaaattgagtccataatctcagctcataaggtgcttgataattctaatataacaactaaaactgtcaaatgaagtctcttattctgagaaataataagtctttgtgactgtcataaaacaggaaacaatttttgtttgtttttagagacatagtctccctgtgttgcccaggcttgtcttgaacttctgggctcaatggatcctcccttcctcctaagtagctgggattgcaggtgcatgcctgagaaataataattcttgccgctaatttagtccttctgtatgttattttaagtaagtatttagtctgttcctttagtaattcttctataagtcatggaagacagctactgttggtaactgctggaatgatgtgcagactgagaatatgaaaacagaaactctgacactgaaagtgattggtcacataggcaaatgttgatttattttccaaaaaggaacctggaagagtgaggagttattttctagagttaacctgaagcagtggccgagtgccatgcacacgtgtaatctcagcactttgggaggccaaggcaagaggatcacttgaggccaggaatcgagaccaggctggccaacatggcaaaaccccatctctactaaaaatacaaaaattatctgggcatggtggcacgtgcctgtaatcccagctagggaggctgaggcacaagaatcacttgaacccgggaggcagaggttgcagtgagccgagattgtgccactgtgctccagcctaggtgacacagcaagactctctctcaaaaa

SEQ ID NO: 90592 - DNA, 310 bp, Homo sapiens
cccactgtctgcaccctcagattttagtttgatggaaccccatggtgtcagcctctggaggcttcttgtcagtactagaaactaatacttggtgaatatccttttctgcttccattaccttgtatgaaactggttccatttatacactgagattagaagcattcataagtgatgcggcaccacaaacacagaagatcaaactactcacagtgtggagaaccatgtcttttataagtgtgatgtgcctaaaaccatcatcaactaaaaaccctggtacttacctatctaagacaccacatacaagtttaaa

SEQ ID NO: 90593 - DNA, 436 bp, Homo sapiens
gctgcaagtgtcagcatgccacaactttagcctgtgtctcctgccttccattacagcagactgcttgctcttctctagactgccgtggcagggaactatggggaggcgaaagaaacacaccactggaactcatagggagctgaaatggtaacaccagtgtgtcacttacaaatggtgataatgaggccaggcacagtggcttgcacctgtaatcccagcactttgggaggctaaggtgaggggattgtttgaacctgagagcttgagaccagcctgagcaacatagtgagaccctgtctccacaaaagataaaaaagccaggcatggtgttgcatacctgtggtctcagctactcaggaggctgagttgggaggattgcttgagtccaagaggttgagattgcagtaatctgtgatggtgccactgcactccagcc

SEQ ID NO: 90594 - DNA, 346 bp, Homo sapiens
aaaccatgaacaactgacctgatccagagcagatggggtttggggagtcatgctaatttaatgctgattacttgagagatgtacagtttacacattatttgaatcagaacttcataaaatatacctcaattaaaactactagaaaatattcatttgggtatggtggttcagaaagcactttgagtacttggaatacttcattatcaagtatcaactgaacataaatgatcactgaagcttacctttatcattgcagaaagagcagtcaatgaggctgagtctgtgctgcttctatgttgagacctgcctgccaaaatctacagagacccctccctgacctgttctc

SEQ ID NO: 90595 - DNA, 429 bp, Homo sapiens
ggtggccaggctggtcttgaactcctgacctcaagtgatctatctgcctcagctcccaaagtgctgagattacaggtgtgagccaccacacccgacctcaaagcatttctcatatattggccttactagtctacaaacacaccaagctccatcctgtgctggaattttatacctgctcttccctctgcctgattatacctctgccccaaacctgtgtatggcttatcccttcattttacccaggtagtagtttagatgtcccttcctcatggatccttctatacaaagtgccttgcccctttccaccaactgtcactataatttcaccttggtttaacggcctaactgcatgcatcattatctgaaatgatctcatgtattacttttctttggcacacaccctccctcctgaaatacacaggataacag

SEQ ID NO: 90596 - DNA, 372 bp, Homo sapiens
gcttacttggcagtaacaaactgcaagagaagtaccttgcccagcctatttattctttaaaattagatttatagtgtgagtccaactatttttctaactatacagtaaaaagactaaaaaaaataagcaaaatgttaattgtatgtatctctgaatagtgggatcacttaacattaaggattttaattttcttctattttctccattttccaaattttctacaatgattaaacactacttttaaaataaaaaacacagtttttaaaaattataggccaggcacggtggctcacacctgtaatcctagcactttgggaggccgaggcgggtggatcacctgaggtcaggagttcaagaccagcttggccacga

SEQ ID NO: 90597 - DNA, 279 bp, Homo sapiens
agtaccaacaatcctcaccggctcacatgcacacttaactcgcttccaaactctcacctccaccagggacacaggagacagccctcacaccacactcagcccctcactcacgcatacatcccaacaagtcacggagcgggaggacgccttttcacatagattcctcgcaggcacgcacatttcacacacaggcccacatcattgcctacatgcttaccagcttgttttttttttttttttttttttttttttttttttttttggggggataatatttta

SEQ ID NO: 90598 - DNA, 749 bp, Homo sapiens
gtgtgaagtaagcaatctattttcacttgctattaacagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggttgaaaatggtccatcttcagtggtcacaaggatacttaaatctcagcatgctgcaatgttccgccattttcagcaaatcatgtttatatacaatgacacaatagcagcaaagcaagagaagtgcaagaca

SEQ ID NO: 90599 - DNA, 500 bp, Homo sapiens
tactgggccgacatcgcaccactgacgcacacgcatcccaggagccgggaaaacaaccagatggtgaagacccggacagaatgtggacaaggctgcaccatttagtaaaatgaaaaagttaaggcaaaggacaccttgaaagctatttattgctggaaagctagttctcagaatgctgaatgataacacacacaatgttaacaatctacttagaaagcagcagaaagattaggagaaaagcccagggatttaagaatattccttggttcttctcacaaaagccatccagaggacctagttttaactccacacccacgcttcctagttcctctacccctcaatttgaatttgtgtgacagccactgaaacaatccagaatgacctccagcttcaccctcactgttctcagaggtgtgaggattaaaggattagtgtgctcataactcacctagcacagtaactatcaagaaagaggcatcctctcaagtttagctcccagc

SEQ ID NO: 90600 - DNA, 357 bp, Homo sapiens
aagtctaagataaaaaacaactgcttgaacaaattactgctttcaccaaaagtatgaggaactaaacatgtaccttcccccatttctgtattctttctttcttacttggaaaggaacaaacttcagctgccattcctactccaagtaaaacaataaggaagagagaaggcctacgatatacaactaaataaaagacaaaaataaaccggatttatctggcagagcgggtctgtttgctatggtctaaagctagactcccatgccagccaccagccctgtgaattgatggcttccatccgtgaccttcctttcacaggtcgtgctaagccctcacactttcctcaccttggccatctg

SEQ ID NO: 90601 - DNA, 153 bp, Homo sapiens
gcagtgaaggtgaggggggtcttatcctgagattgagttagttgatttttattctgaaagaacgtattactttttatggtagcctacattatgtttcccctcttgtaggtatgttttctgagtcttgaattgtttttcttttttttttcaaaa

SEQ ID NO: 90602 - DNA, 303 bp, Homo sapiens
gggattttataaataattgcatactgataaattaggtaatttggatgaaataaacaaattgttttaaaaatacaatttacaaagctgacaaaggagaactagaaataagtagctttattggtgaattggaaatattccaatcctacacagtctactggaaagtagaaagcataagcatttcccaatttcttatataaggcctgattccaaaacttgacaaggacatagcaagaatagaaaattatagaccaagttttctcctaaacacagatggaaaaactctttaaatatttagcaaatcaa

SEQ ID NO: 90603 - DNA, 694 bp, Homo sapiens
ccttccacattgactgctgaattgttttatttagaaaaatcacagttttttagttcattaagtctttctcctctaattcagtatttttaagtgttcttcccatttttcagtaagcacagtcatctgcctcctacaacagcagctctaaaactgagcaccacctgtccttagtgagtcttctaggtcttcctccctagatgagtaattcttttcctttttacatcagggactctgctcaatatgcaggccaaagagttaggcagtggtttgctggtaaatgcttaacaaacaactggggtgtgggggaaggagaaaagccgcagggtacaaccaatttccttacagtaaatactttcttcatggctgattacaaactaccaacttcaaagaggatggcttataaagatgtgcacacatggctctcacaagtgcagcccagctcccatggagagagtccccggagaggtattccaatagtctaaatgctacctcatccttaaagcctttctttattccctcaaatggaactgggtttccggtgttttgttgttgttgttgttttgttttgtttctcttctgtcaagatactttgcttacatctttaccaggcacttactttatcctgtcctgtagtatagtgggtactttacattattatttctctcatgatgtcagctcactaagagcaggtaaa

SEQ ID NO: 90604 - DNA, 796 bp, Homo sapiens
cctcctttgcatttcagaaagcggaaggggcaggcctagaagctgaaagaaaagctcgataatggggaaacagtgttttttccttcaattaatgattaatttctcagctggtggggccagcagtctctgaccgtcacgtgacagctatgcgccccatgacgcctctccagggaggcagagtgggtggcactgaggtggagctcaccttcctgaaattcagccccctcagtttggaggaaggaggtaaactgtttcctgtccagccagaagtttgcggagggccttccccaggccaggcaatgctgcctgcgactctgtccctgacagcgttggatgcaccgtatctcttctgatattaagtctggaagtgatttactatccgagtcctcccacagttcgagccttttgatgtactttgtgtgcatgtgtttctgtcacatacgtgccacagtggaacagattttgttttgacactattttggttcatgatgttatactttgactattttacaataatagccaatgtaaacaaacatctttgggattctcaaattattacttatgattcttggacattgcagctcttcgatactgacgcattcctagctttttccaaggacaccgtatgttaacatccgtgccagcctcattatccccacagccaggctctgggttgggcggtaatgagcattgtgcggtttcactttacactttgcaaagttgattaaggcagtgccttctcccatgatcatttttgtaccctgatgtagtaaaatggctaaatatggtgaaagtt

SEQ ID NO: 90605 - DNA, 1959 bp, Homo sapiens
ctagacagacgcggcgtgaagaagtgatgtattagaggtgggcctccggtgaacgggcttcgtaaaaaacatttcgggtgggtgaaaaggatggtgcgtcccctcagattgttgtgtgagccagcccgcctgaaattgatagagggatgccgcttctaccgacaagcaagtttgtcctcacatggatggggacagtagatgtgtcccagccgcacgtcacgaacgtgtttctgttgaagaaccagcgcggccccacaatcaagagggggtgatataatggcggcgcgttattatgggggcaccacgttgtgtcacagaagaaaactctgtaacccctcttaactcttggcccccccgcggggaaactttttaatgcgcccccccctttttttgtttttttttttttttttttgtttttttgttttgtattgttacatgaaggcacagagaggtgaaataagggagattaggcagagggggagattgagcagctatgcaatgccaaaaaaggcctctgccagcccatgggtaactctggagttggactggtccttcagagttgtcctgagttgggggctgggacacaggcctttatactattccatttatgtggatgtgtcattgaatgtgaactgtcccttggaggaggcatgattttgagtgaggcaatttcctcgggtaaggcagtccccaaagaaagctgacagctgagggctgtctactggcagcacttcccacagctgaaggaagaagtcactaatgaccaaaggaaaatctggaggcgcatcacagggctcacaacatcttcatcacaactttatgaggataacacttttatttttcctattttgcagatgagaaaactgaggcacagagaggtgaaataaggcccccagaatgctcttctccaagacttagaaaaatcaaatgctatccatccctcaagatacatccctccagcccctccttgaagtctcctgcagctagaagtagaagtagcatctatccccatctggactccttagcactttgctgtacctgccttagtccccatctctttacacacacacacacacacacacacacacacacagagtattataatactattacctattatattacattatattattgtagttctacaggaactacaaggaattctactgtgaattccttaagggtgggatacattttacaatcatcactgtttctctcattagttgtggaatcaaaaaaatgagtgcacgatgaaaaattattcaaacacatacatgctttcattccaattgaaaatgtaaaaatattactgttaaaacaatattaaaggacatgtaatacaattcaaaaaaaaaaaaaaaaaaaaaaaaaaaaaaaaaaaaaaaaaaaaaaaaaaaaaaaaaaaaaaaaaaaaaaaaaagagagaggggggcggcgcgcgccaccaaactcccccccgcgcggggcgcccccccccccggcggcgccccccgctttttgagaaaaaagggggcgccccaaaagggggcgcaaaataaaaaaacaaagcggggggcggtaaaaaaaaaaaaagaggggggaaaaacaacgaacgaggaaaaatagagaaaaacacaccaaaggggggaggaaacacaaagggagaaaactccccacaaagaaaataaaacacaaaagaaacaaacaaaaacgacagaagacaagagcgaaacacaaccgaaatcaccggagcagacaaacacaggccgccaaaagaggacacagccaaagaaatataacgggggggacaaggacaggaaagaagcggagtcaggcaacggggagcagaaggccggcatgccaggcccggcagaaagagagaaagagcgagaagcggcagcgaccaacgcggcggggggagggagcagaggcaccaggacggacgccgggcacagagaaatagccagcacaagaaacaca

SEQ ID NO: 90606 - DNA, 277 bp, Homo sapiens
attatattacattatattattgtagttctacaggaactacaaggaattctactgtgaattccttaagggtgggatacattttacaatcatcactgtttctctcattagttgtggaatcaaaaaaatgagtgcacgatgaaaaattattcaaacacatacatgctttcattccaattgaaaatgtaaaaatattactgttaaaacaatattaaaggacatgtaatacaattcaaatattcctaccatgcacgattgttttcacttctttgtgcctctt

SEQ ID NO: 90607 - DNA, 1249 bp, Homo sapiens
gagacggagtctggctatatcgccaggctggaatgcaatggcgcgatctctcctcactgcaacctccgcctcccgggttcaagcgattctcctgcctcagcacctcgagtagctgggactacaggcgcgcgccaccacgcccagatgagaaaactgaggcacagagaggtgaaataaggcccccagaatgctcttctccaagacttagaaaaatcaaatgctatccatccctcaagatacatccctccagcccctccttgaagtctcctgcagctagaagtagaagtagcatctatccccatctggactccttagcactttgctgtacctgccttagtccccatctctttacacacacacacacacacacacacacacacacagagtattataatactattacctattatattacattatattattgtagttctacaggaactacaaggaattctactgtgaattccttaagggtgggatacattttacaatcatcactgtttctctcattagttgtggaatcaaaaaaatgagtgcacgatgaaaaattattcaaacacatacatgctttcattccaattgaaaatgtaaaaatattactgttaaaacaatattaaaggacatgtaatacaattcaaaaaaaaaaaaaaaaaaaaaaaaaaaaaaaaaaaaaaaaaaaaaaaaaaaaaaaaaaaaaaaaaaaaaaaaaagagagaggggggcggcgcgcgccaccaaactcccccccgcgcggggcgcccccccccccggcggcgccccccgctttttgagaaaaaagggggcgccccaaaagggggcgcaaaataaaaaaacaaagcggggggcggtaaaaaaaaaaaaagaggggggaaaaacaacgaacgaggaaaaatagagaaaaacacaccaaaggggggaggaaacacaaagggagaaaactccccacaaagaaaataaaacacaaaagaaacaaacaaaaacgacagaagacaagagcgaaacacaaccgaaatcaccggagcagacaaacacaggccgccaaaagaggacacagccaaagaaatataacgggggggacaaggacaggaaagaagcggagtcaggcaacggggagcagaaggccggcatgccaggcccggcagaaagagagaaagagcgagaagcggcagcgaccaacgcggcggggggagggagcagaggcaccaggacggacgccgggcacagagaaatagccagcacaagaaacaca

SEQ ID NO: 90608 - DNA, 702 bp, Homo sapiens
ccgtagagctatacacgtggtattactgtgaacagcgcgcagtccgggattctaatcacgtgtctaccttgccttccccagatcacataaatctaacagatctctacgcacataccaactgtcagacactatggtactgctccacttgtaaattatgttgcatcttcatgattagtctacagtgtaaggacagctgtagcatagaggtctgatatctgccactatgaaacagttcctcacacttgttttattatccatccatgtgctgatcatagtagtccttctaccataggagctgaatggtcatagctgtaaacagaagtgaagtctccgcgcgcgtcttagaccagaatcgcaggctggatccggctcggtgatctctagaggagggtctcacgcgtgtaatgccgatctaccaggcgatcgtgacggtacgtgaaagatctgctcgtctgtcatatctgagcctaccctaccgatgcagccccctgaagttttaacagaatattaattgccctttcacttcccattccacacagctgggtgggattgctaccagccacactgttgagaagttacacattttagcccagcctagaaaggtttcctgtggtgggtgaaatgacaacatgcacaaaggtcaaactccagatgtgggaatctgaccttttctcctcttggggaaaacattgcctcattata

SEQ ID NO: 90609 - DNA, 344 bp, Homo sapiens
gtgctttgtaaaaattacatttgaataaaaggataagataaaagaataaaaccagagtctacggaaagcaagcgagggaagccccttgctaatcatgtgatcacactgctgaaagactaagtacagggtgatcaccaggccagggacaaggtaggaaggagaatttaaacaaacgaaaaaacaacaaaaaacacatttaatgcttgtttctctttccttcctacctactacacctcacttaagtgaacactcaatgaatgttcatatttatacaacaaatatttaatgtgagcttaatacttaaaaagtgcttcctgaggcccaagccctgggatgcagtgatg

SEQ ID NO: 90610 - DNA, 465 bp, Homo sapiens
gaagcaatatttgtcacattagtgggcttctctgacccacttatggggtgtctcaaaagggagctaattttgagaaggggctcaaggcagaggagatgctccatttggttcaggctgcaatgccatctgttttgtcatccatgactccgtggatctaacggtgctcaaagtgtcaatggcagattggagaggtgtacattacctgtgacaagccctgttaggagaatcacagtgtcagttataagggtttgggaacacatacatgccttatttgtcaaataactatttttcttttgagagaaagagatggcttgctcctgggctgtggaagagactgaatgtctcatcaagaaggcagattaccatggagtctgagctgcccgtcttgagctgcatgttattttgatccatcaagccaccaagtcaggttccccaaaacacccagctctactggaggctctcagc

SEQ ID NO: 90611 - DNA, 662 bp, Homo sapiens
  misc_feature (281)..(281): n is a, c, g, or t
  misc_feature (467)..(467): n is a, c, g, or t
  misc_feature (660)..(662): n is a, c, g, or t
gggacagcacaaatgttgaagtttggggaaacattttgtacaactttgttcactgaatcacagtcactgcttgtgctgttgataatcaaaactaggctgcacagagtgacgtagtcacatatttggcttgggtgtacagatgtttcccttcaagcatcttggatgtcttgctccttatcagaattttatctcccccaaattcattgtttgtgaattaactgtaaagttctgggagcgatttccttttcaacagtttgcctttctagaaaaaaacttttggngtttaaatagcacttaaccctctatcattttactctctctgaagtggtctctgtggagaacatgttgggtcttctctgttcaatatctctctctctctttcttggcaaagcctggatgcgagaagttggtccaatctttcctgtccagggttgcttgttaatacagcatctggagcaaaggaaagnctattagcaccttgtcacttggagtttcttaagcattgttccatttatgtgttctttctgcagagatttaatgaaagtggcatctgtctttacacctgacatatgcaggttgtccgcagaactgaacaagtggtgtcagcaacacgatatgcaggaaggcttcatgctcacgtcgttttttctgtgttctctnnn

SEQ ID NO: 90612 - DNA, 375 bp, Homo sapiens
ggattacaggcgtgagccactgcacctggtttcaacaacagcattgatgggtgaagtagcagaaagatgaaggcagctgatgcactctcggggcattttccctctgtttgatggaagctggttaattgagtgcagaggatttaaaacctatctggcccaggcctggcacggtggctcactcctgtaatctcagcactttaggaggctgaggcgggcagatcacttgaggccaggagttcaagaccagcctccccaacatggcgaaaccctgtctctattaaaaatacaaaaattagctgggcatggtggcacatgcctgtagtcccagctactcaggaggctgaggcaggggaatcgcttgaacccgggaggtgg

SEQ ID NO: 90613 - DNA, 355 bp, Homo sapiens
acttcacatcatctggccctactcttcaactcaaccttcttccctacatggaatctttattccaataatgtctgtttccttctctcgaacacaccatccaattccattctttgctctttgttgaaattctactcaaccttggagtcctcacaagctgtcatttcttcacaaagtgtccctcactacccttaaacccaccctctctttcttttggttggctagagagattcacattcaattagggtccccttgtgtgtttctctaattgtttcaggtctcccaggtgactttctttgggttggggggtgtcattatatacttgcacagcacctagaaccacgctaagccagttttg

SEQ ID NO: 90614 - DNA, 509 bp, Homo sapiens
atttcttacatttcagacaaaaccctgttagtattttatgtacattaaacattcaatttaatttggaaataatagcttcacaacattgaattgtctcatccaggaacgtggtaaatctctgtttattcccacattcctttatgtatctcattaatgtttgtagctctttctcccattgtgttttctagtctggttgttattggtatataggaaaagtttatttttgtgtatattatcttgtatttagctgaactctcttatgaattctaacaatttctcagcttcttctcttgagtttttaaagtaaacaaccatattgtttgcaaataacttatagcttagttgttcctgggccaagttcagacattaggctatcataaggtaaactcaaatcctattggcacaatataataatacattgtaattttgttcctaaagactcatctcacactgtaaaaatgccaaaattgatcatgaaaataaatgaaaagaaaatccaaatatattat

SEQ ID NO: 90615 - DNA, 409 bp, Homo sapiens
agctttggagaagagattaaattctaggtccccaggaatatcctgataatcaagcttaccagcagagataagagaaaaaggtcctctcctgggcacaatgcttccagtgggagggggcagaagctctgtggctaggagggggcagaagctctgtggctaggagtgagaaatcctgggcagaagatgaggacttctatttccaacctgggtagccctgggtactcaaatcaggctttgtggtttagggagaaggaggagggaatggagactggggttcttccaggctctgccctcatccatcacaggtttctggatggacttgtccataaaatgaagagtaggacaggaggatctagggcacaatctgtatcttacatttcatgattctagatttcccaggatggcagta

SEQ ID NO: 90616 - DNA, 837 bp, Homo sapiens
gcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggtgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagcccacgggaagagtacggctctaggcagctccagctggcagtgcctggagcctacgagaagccacagctcttgcccctgcagcctcccacagagccaggctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctag

SEQ ID NO: 90617 - DNA, 908 bp, Homo sapiens
gcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagaccttgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagcccacgggaagagtacggctctaggcagctccagctggcagtgcctggagcctacgagaagccacagctcttgcccctgcagcctcccacagagccaggctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctag

SEQ ID NO: 90618 - DNA, 508 bp, Homo sapiens
gcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcgggtaacgtacctgagattacctgggaaacccggactgggggagtcctgggagctgcagtgccctgtgaagactgagaccagccccagccctgggttttgagttggggtgggacctgtttattctagatgacctggcagagcttaaattagaccttggctcttaaaaatagctccctccgattaggaaatggagggttagttcacttgacacttgtctggggtgggttggctttcaccaaggatgcgcgagcctggctgtagagtccacggagctggtggggttgtgaggggagagtttccctcccagtaggcagcatgctgatgttatctctccta

SEQ ID NO: 90619 - DNA, 567 bp, Homo sapiens
atgttgcccaggccaacctttaactcctggtctcaggtgatcctccccagttgtacctctcagactgattataggtgtgagccgccacacctgacctataattttattttagatttacatgagaagtgatgctgttttaaagtgtaatgctctgaattaaaggaattctctatggtaatatatttatacataacaaagcactaacaattacagaaggccttgatgcctgttctattattcgttttatgtttctgtgagtaattgatgctttgatgtattttggccatagaggcactattgtaatgcatgtagactgactttcactggacagaggtttgctgagctggttctgttcatgtgctatggctggagacatgaggcagaggacacagaggccctgccctgatggcactcacactgtaaacttgaggcaatgaggacgcacagttaggagctgaagttgtaccacagaacacataaagggagagttagacacaagacgagggggctccaggtgagccagtgagagccgtggggccttctgtccctccagccagcagacgctga

SEQ ID NO: 90620 - DNA, 303 bp, Homo sapiens
actttgtaattaagagggtattttaagtgtaatatagtatacgaggtgaaaggagaaacagagggagatgataacgaacagaagatgctcatttagaagggaggtccctaccatagttaccagaactttgagtgtacatctgccattagcagtcattaaatgatcagtggcattaaattgtcaggaaagttggggcataaaagtgagggtcaggacctgaaaagctggaacttcattctctaacaggaatcttgccatttatccccaaagaaagaaaacacacttcagagctaaactagacag

SEQ ID NO: 90621 - DNA, 864 bp, Homo sapiens
ggaatgctgggtttaagtcgtattaatttcctgggcttttttgagtatagtttaggaactttcagctcctcacttttcctacaactaaggcaaagaaaagaagattatgtctatctcacagtttaaagggataagtcttatgattataaattcactctaggctgggcgtggtggctcacgcctataatcccagcactttgggaggccgaggcaggtggataacccaaggtcaggagtttgagaccagcctgaccaacatgacgaaactctgtctctactaaaaacacaaaaattaccctggcatggtggtgcgtgcctgtaattccaactacttgggaggctgaggcaggagaattgcttgaacctggggggcagaggttgcagtgagctcagatcatgccacttcactccagcctgggagaaagagaaaaactctgtataaaaaaaaaaaaaaaattcattccatatgtgagcatgcttaagctctctggaagaaccatctgaaatgtagtaaaacaattaatgagaaaagaacaggattgaaattagctgtaggatagctcagaggaaagaagactcactaattcagaatgtacgagtactagctaaagtaagcagagaagaacacacttcatcttcttagaccactgagtctttttactggtcccttacccctaccctgaatagttacattaacctctctcactggaataatttcactaagaaaacagaagctattttaacaaagccacaaatttgcttagatttacatgtagatttctccatatcttcctcaaacaacaaaaaagctcagtgctggaagaatgcttcaagatcttggaattcttttatcctatgcatgtg

SEQ ID NO: 90622 - DNA, 395 bp, Homo sapiens
ctgggcaaaaataaaaataaataaataagtaactcgctttaaacataacatttagttaactctttaagagcttcatgatggcatttggctttaagagcttcatgatggcatttggctaagggccacctcaaattctgatccaaagagaggtgtcacagaagatgagaaatctgaactgtaggaattcttatctttttaagcagaggtatcatcagcaaatcatgcataaaaatatcagagtactagtctatttgtaaataatttaagctcatccaacatccaacataaagaaaagctgcacagacaagaatgcagccttctcaaatgagacagcagtggtttggcttcaagtgacaaggataatttacatcagtttacaaattaactatcagtat

SEQ ID NO: 90623 - DNA, 175 bp, Homo sapiens
gaatagaaagaaagaaacttattgatgtcagtggccagtccattaagtggggaatccaaaatgaagtgatgatgaaaaacccaattaagtggctgagcgagcagaagccaggaaatctccaaatatagattcaggtccagaaataggcttcagttttaaggtaccagaagcccag

SEQ ID NO: 90624 - DNA, 447 bp, Homo sapiens
cagaaataagggtcaggactcaaagcagtggacataatcaggacagaacaggccgaagtgcagacacaaaacagatcaataaaacccaacagctcagcaaaggtgaggcagctgtgtctccctctggctgccttttctcccctcctctctcaccagaagccaacgcgtacacgctgagtggagaggccgcgaggacaagacagtgggacatgcgtgtgctggggaagtcgagaagcaggacaggaggcaggtctgagagatctggtttgtgtcttgtgccctggttctctctgcattccttctctgtctctttttcccttcctcatgccttttccttagctgatttccctaggacagaattattttctttttcggactgaatggtaaagaagtatttgtttcctaagtcttcatttcaaaagcaacaggatagaactctctaagaca

SEQ ID NO: 90625 - DNA, 700 bp, Homo sapiens
tccagcactgggactatgaaatttgagatttaacatttattcattagtcagatttaaaggaatttaccttaagtcatagtttatattgtttttggaggacctgagtaaggattctattaaaaatgattaattttgtcattatttgaaatattgataggattttaatatgttccttttttgaaaatactaaaattataaattaacttacacttaatagcaaatagttcgtaagtatgtcgtaatcaacttattgactaaaaattttgtaaaagatgccatttatttaaagtggcctatcgtatagttactataatgctagtgctctctacattttcattgtaatcttactgaagaagtaaaaattaatcattattgttctccccactctaatattaattcagaaatcataattgtacacatagggtacaacgtaatgtttatatatatgtgtgtaatgtagtatgattaaatcatactaattaacatactatcgccttactttgcttacttatattttgtggtgaggcatttgaaatttactcttaattgtttgaaatacattattattattgctattgttatctctgtcttctctttgcaaataaataatcattatttactatggccaccctgttgtgcaaagatttcaaaaactattctcctatgtgaaatttgttcccttttctttttcaaaaaaaaa

SEQ ID NO: 90626 - DNA, 434 bp, Homo sapiens
atgaagtgtgcaatcagtgatgggtaaaacattacccttgccatcaaagagcttatggctagtcagacatgtaaacaattaaaacacggtgtggtaagtgctgctgtagaagtatgtgtacgttgttaatggaagcacaggggaggcgacctaagtcagttcagaggaattaggaaaggcttcacaggccaggcatggtggctcacccctgtaatcccagcactttgggaggccaaggcggatggatcactaggtcaggagttcgaaaccagcctggtcaagatggtgaaacctcatctctactaaaaatacaaaaattagccgggcgtggtggtgcatgtctgtaatcccagctactcgggaggctgaggcaggagactcgcctgaacccgggaggctgaggttgcagtgagctcagatcctgccagtgcact

SEQ ID NO: 90627 - DNA, 648 bp, Homo sapiens
gtccagttgacttcccttcctactacctcaggttcctcatttacaaaatgggataataacaagatcactctcaaagggttgtaaggatttgctgagattgtatttctagtccagcgccatctctcactaagtagcagctcttatgtattataattgttcttcaatattctccatctggcccagagactgcctgactgtgggctgtgacatgacagccctgagctcccccacacatttgctcccatcctcagtgtcccatctgtggaatggtagtcataggacttttgtgccaggattgtttggatggttccaggagataattcatgtttagtgctttgcacaaggcccggcacacagtaagtgcttattaaatgattaaatgtatcttgctgttttttttttaataggccctttttgcttctgtttgtacctacatggcagagtgagcacaaagttagtgtttttttatcttccccctccctcccaaattttacttaccaaagattaaattatggaacacactatagtagaaaggcctaagaagaaatgggtctgacctgccatcagcagtcccctgctcacacacccctccccacagagccagtatgttcactccagtgctttaattattgtcctggtgctgccagc

SEQ ID NO: 90628 - DNA, 200 bp, Homo sapiens
taaacaatttatgccttccagacttatttgaaaggtcatctttatcatatactgtactcctgtttgtatttggaaccatttccagtcttcttccatcctaacactttgtttattcatataatagcaccccgctaatttatttacaatgaacttaaatatattttaatatctggcaaatctatcatcattatattatgttt

SEQ ID NO: 90629 - DNA, 352 bp, Homo sapiens
taaatgctactcattttagctgaaagctcaagttattgtagaaaggcaacacttttgtaatattgatattttaacctctttttcattttaccactcaaaaattgctaataattgaaatggaatgttctttgtaagtttattttatatttgggagctaaaataaacaacagcatttgcttaaaggttttgaactatggcatattaatggtacagatatggtttatctattgcagaattgagtcatatgcaataagaaacagcataaaatccataaataagattttatgagggaaaaaatcagtgttacatatacatttttccccgtttctggcaaatataatctttcattcat

SEQ ID NO: 90630 - DNA, 576 bp, Homo sapiens
agtgatttcccaacatggcagccagtaatcagaaacatgctgctgcttttgaaaaggtagcttgttttttttcttggaacatactgatcttctgagttatatttttcttagagcaaagccaaggcatgtgatgccacctccccatgcctgccatgcatctgtgcacactactcatcgcttctgcacttccaggtggggcctcagaccttccaagtttagggttgcaggacagctgacttgccaaacctgccatagctcatggaggtgacctagaaacgttccgcgttggggctggggacagcccgaggtgtggggttgccaatggacgcacagccaactggggctcgacttgtgacgatgcaagcacaccaccatgcctccttgccaggccggtccctctcatgctctctgagccatatggccaccaaatccatccctgaacacttactgatccaaagaagaccctgacagtcttctccagaaaagtaggggggagtgtgaaagtaacttggggtaccactcctgggttcagttcctgcctctggtttagcggccatgtcacgatggatgagtcac

SEQ ID NO: 90631 - DNA, 128 bp, Homo sapiens
ttattctcttttagtttcctctttcttacttatctaatatcatccactctttaaaacattgaagaatggctttcactccaatattactatcttcttccatcagtcttaaaataatgaccatctaattg

SEQ ID NO: 90632 - DNA, 376 bp, Homo sapiens
gtccgacaactgcaccactggacaactgcacccacagaaactttaagataacaaatgtttgttgtgttacgctaccacattttgttatgcagcactatataaccaaaacgggaaatgcatggtgagtttaacagcaagcagacaacaggaaagtcacagtttcacagcagaaggagtaacctgcatacacggatgagattttctctattgttaagacaaaagagaaatcagatggaagacctgagacacactggcttcatgcaatcagacttttggtcaaaaatcaccaagggaaaaagagaggggaaagtgtagatgaacgttgactgaacagttcaatactgcactccctccagagagtccatagtgggggctc

SEQ ID NO: 90633 - DNA, 491 bp, Homo sapiens
cggccgggcatggcgtgctctcgcgtcacgcgactctgcatcccgggttcaaatatcctcctgcctcagcttcctgtgtagctgggaccacaggcatgtgccaccacacctggctaactttaattttttgtagagtcaggggtctcactatgttaggctggtcttgaactcctgggctcaagtgatccttatgcatcagcctcccaaagtgctgggattacaggtgtgagccaccacacttggccttctttcttttctttccaatccatttgttttttatttcttttccttgctttattgcactggctaagatttccagtgctgaataggagtgatgacagtgggcatccttgtctttctcccaacctcagagggaaaagtatcaatgcatttgtagatattctttatcagattagcttcctttctagcagcttgtgtctttgtattgtttttcatgagcaagtgttgaactttttcactgagttttccaa

SEQ ID NO: 90634 - DNA, 424 bp, Homo sapiens
ctaccagcaggaaccaccatgcaagttaggtgctgaggtcactcaatgagaaacacaggcaaagtccctagcaagctctgaccccttgcaaaggccagcctcaggcccatccatcccccagagccagggaccctgccccagtagaaacccctaagccggagacccatcattagaggccatgactgccaccagcttgggctactcggtctcattatgtccctgggtatgggtggcagccacttccctgtgcccccagcagagtgtggcaccagaactgcccggctccgtgggtgcatctcattatctgaatgtctgccatcagctgtgctgaagcaaagcggcactgggaactcactctgtacttttgcctaatgttctaatttgcccctgcagaaggggaataacccttttctggaggctgctc

SEQ ID NO: 90635 - DNA, 1755 bp, Homo sapiens
ggtatatgatactgccctgatacattaaaaaatgctcaataaatatctgttgagcatctgttcttaaaagactaaagtcagagtattagacaggtaggaaaataattctgaaaatggtatcatctatctagcatggtccccaaagtttagcatgcatggaaatcacctgacagaaggttacacagcacagactgctggcctcccttcccacattttttgatgcagtagatccagggaggggactgacaatttccatttctaataagctcccaggtgatgttgctgctgctggttgtgaaatgctaattgctttttttctttcttcttcttttttttttttttttttgaggttgttgttctctagcttttcctgctagaaaatactgattccttatcaggaacttatcctctgctatctactattttgtataaaatatcaagggaacaaaaggctgtttgataagaacaaacgttttcaaattgttttacttacgtttatttaaaagaaagcatttttctcaatctattttattattacagtgaagatgaaacattgagcatagctagcaaatgcttctttaaagcttgatttagatattcaggttcctaacatttgtttttttggtttttttttgagatggagtcttgctctgttgcccaggctggagtgcagtggcgtgatctcggctcactgcaagctccgcctcccgggttcacgccattctcctgcctcagcctcccaagtagctgggactacaggcgcccgccaccacgcccagctaattttttgtatcttttagtagacacagggtttcaccgtgttagccaggatggtctcgatctcctgatctcgtgatctgcccacctcggcctcccaaagtgctaggattacaggtgtgagccactgtgccgggccatcaggttcctaacatttggcaaagtaatgtgatagtgacagatcccaaaagataaaaacatgggcaacatgtcatactatgcacacggaaaaccaaaatcaagccaaaataggacacaacttcattcactaggtccctgaagacctccagctttctgtttgcatccttatcacaaaacctaggatagttacaataaaaaagataacaagtgttggtgaggatatggagaagctgggaccctcatacaatgctgctgagactgtaaaatggtgtagccattttgggaaaacagtctgacagctcctcaaaagattaagcatagttaccacatgacccagaattctattcctgaataatatccaaaggaactgtccacacaaaaactcatagataaatgttcacagcagcattatttgttatagcaaaaaagtggaagcaacccaaatgtctatcaaccaatgaatgaataaacaaaatgtggcatatccatgcaatggaatttacccagcaataaaagtacatgaagtactgatacatgctacaacatacatgaaccttaaaaatgctatgttcagtgaaagaagccagtcatacaatatgtggtcacgaaaccatattgtataattccatttatatgaaatgttcaaaacagacaactccataaagaatagggtggttagtggttgctctgagtcgtggggaatggggggattggaggatcatagctaaaggatacagggtttctttctggagtaatgtaaatgttctaaaattaattgtgatgactgcataaatctgaatatactaaaaatcattaaactgtacactttaaatgggc

SEQ ID NO: 90636 - DNA, 781 bp, Homo sapiens
ggtatatgatactgccctgatacattaaaaaatgctcaataaatatctgttgagcatctgttcttaaaagactaaagtcagagtattagacaggtaggaaaataattctgaaaatggtatcatctatctagcatggtccccaaagtttagcatgcatggaaatcacctgacagaaggttacacagcacagactgctggcctcccttcccacattttttgatgcagtagatccagggaggggactgacaatttccatttctaataagctcccaggtgatgttgctgctgctggttgtgaaatgctaattgctttttttctttcttcttcttttttttttttttttttgaggttgttgttctctagcttttcctgctagaaaatactgattccttatcaggaacttatcctctgctatctactattttgtataaaatatcaagggaacaaaaggctgtttgataagaacaaacgttttcaaattgttttacttacgtttatttaaaagaaagcatttttctcaatctattttattattacagtgaagatgaaacattgagcatagctagcaaatgcttctttaaagcttgatttagatattcaggttcctaacatttgtttttttggtttttttttgagatggagtcttgctctgttgcccaggctggaagtaagactttgtctcaaaaaagagtaataaccggactatgattcttctaccaattatatgaatttaacagaataagtaggattttatttaatactatcaaacattattgtaag

SEQ ID NO: 90637 - DNA, 343 bp, Homo sapiens
gctacatggcagaccctctgctaactgttttacattactcaccttatctgttagtcctcataacaatgctgccaggcagatcttatttatttacaggaacttgaggctcagattgcttcaaaggaggaggagctggaaggggcgaggttttcctatgaagccaattctattagactccaagcaaatgtgtattccagtcccttagttgccacaccctataaaagtaaaggatttctgaaaggtgaggatcactagagtgttttttccatactttctcatatagctggggtggcacaagcataatctgccacattttccctaattctaagttttccatggtttt

SEQ ID NO: 90638 - DNA, 446 bp, Homo sapiens
tcacctactgttagcatcagcctcatccccattcttctcctctctcctgttcctcctccctctcggaggagatgcagaaacttctctccttgccccaggaattcacccaccatttctgttgcctcgaactcccttgggggtcttactctcgcgcaagcaatttatcaaagtgtttcctgcaaagataattccctcccttagaagaattctccaaacgaaattttctccatctcattacacacacagcctatgtttgctgaactgatattgttactgacaaatactctgcaatgaacttttaattatctcattttgccctgtgacaatcctggaagttcggattctagcattcacctcattcattcaatagttaacaggcagctatctgagctagggtttagggttatggagctgactgtgacccaacagacagtcttttcagaaca

SEQ ID NO: 90639 - DNA, 2286 bp, Homo sapiens
gggaattcggccattatggccgggattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgtttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgcaaaatgtcattttatcttttctaaaggctttaagaagaatatactagaatctatatattgatgttaattttgattcagaaaaaaaatacaacccagtatctaaaaagtgttaactagtccaagatagtaatgcatatgccaaagaaatattacacctaatctcatgtttagaatttaaaatagaattggtcagctacttattcttaccaccctacttccagtattttagctctgtcattattaaattcagatcttcctgattattttttctgttgaaagttaaactactgctttcaagtaatttaaagttatcctaccttttattcatgggtagttttgcaaaattaacatggtagccattgtttgaatttaatcgggcatcataacttttcatttattgaggaactaatcattattactataaagcatacaaattagccagtcagcacactttggtcttctttacctaagggttaaacatcagaacatcaaatttaattatttgcatagaaatgtgtgggctctttatataagttgactatcactaacaggtaatatttttctgtttgaagttgttacttttgtttacagcaaagtttgatgtagtgtgcagtagtgagctctagactgatctttttctaaatcagaaagtgattaaagtatgcacaaccaaaggcaggtttttctttttcatttattcagcaactatttattaagcatcaactctgtgccaggcacgttactagctgctacatactgtctgaacatgacatacggttaagtaactttacaattattatcaaatacttcaatgtagatatttcttaagttgaaatagcattaactaggataatgctttcatgttattttattgtcttgtgatagaaattcaacttgtaccatctaaaactaggttgctataaaaataggaggatgaagtcaataaagtttatgccagtttaaaaactggaaggaaaaggtaagagctctccattataaaatagttgcattcggttaatttttacacattagtgcattgcgtatatcaactggccctcaatgaagcatttaagtgcttggaattttactaaactgacttttttgcaactttgggagatttttgaggggagtgttgaaaattgccaaacactcacctcttactcaaaacttcaaataaaatacacattttcaagagggagcaccttttatatttgataagttttcattataaaccttataataccagtcacaaagaggttgtctgtctatggtttagcaaacatttgcttttctttttggaagtgtgattgcaattgcagaacagaaagtgagaaaacactgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaagcaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgtctccctgtgcctttataatataaagttgtttctacaacttttaatgatcttaataaagaatactttaagaatcaaaaaaaacaga

SEQ ID NO: 90640 - DNA, 1448 bp, Homo sapiens
gggaattcggccattatggccgggattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgtttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgcaaaatgtcattttatcttttctaaaggctttaagaagaatatactagaatctatatattgatgttaattttgattcagaaaaaaaatacaacccagtatctaaaaagtgttaactagtccaagatagtaatgcatatgccaaagaaatattacacctaatctcatgtttagaatttaaaatagaattggtcagctacttattcttaccaccctacttccagtattttagctctgtcattattaaattcagatcttcctgattattttttctgttgaaagttaaactactgctttcaagtaatttaaagttatcctaccttttattcatgggtagttttgcaaaattaacatggtagccattgtttgaatttaatcgggcatcataacttttcatttattgaggaactaatcattattactataaagcatacaaattagccagtcagcacactttggtcttctttacctaagggttaaacatcagaacatcaaatttaattatttgcatagaaatgtgtgggctctttatataagttgactatcactaacaggtaatatttttctgtttgaagttgttacttttgtttacagcaaagtttgatgtagtgtgcagtagtgagctctagactgatctttttctaaatcagaaagtgattaaagtatgcacaaccaaaggcaggtttttctttttcatttattcagcaactatttattaagcatcaactctgtgccaggcacgttactagctgctacatactgtctgaacatgacatacggttaagtaactttacaattattatcaaatacttcaatgtagatatttcttaagttgaaatagcattaactaggataatgctttcatgttattttattgtcttgtgatagaaattcaacttgtaccatctaaccgtgttgaagtgtaaagttccgttgaagccgt

SEQ ID NO: 90641 - DNA, 351 bp, Homo sapiens
atccctgctctgccacctctccttggtccatttgttctcaagcaaatgacattggaaccaagaaaggaatgtgctctgtttgtcaattgtcaggcaggggacacatcttccctttcttccctcaaagagggactggttcagcctcaaaccctctgaagggcaagatcaggggaagcaggaatgctggagcttcctcagccctctccccagccgtgtgagtcacgggtgcaccaggctccctcctgctgtccctccactgggacactgccccctccagttcgctgttcatactcacaggcagctcgggcatttgtggggcttccccaacccccagactacgtcagacccctg

SEQ ID NO: 90642 - DNA, 502 bp, Homo sapiens
catttctccatgttggtcacactggtttcaaactcctgacctcaggtgatctgcccgcctcggcctcccaaagtgctgggattacaggtgtgagccactgcgcccagccttactgaataattttatgtcactgtccttttttaaaaaaaacggacctgttggttttgaagagtaaaggaggagctctgttcatttttaacatggagtatttaagatagaagagtttctttcagttttatgtatctcttttatttattttttatgggtagagttgtcccttagtatttatgggagattggttccagaacccttgtggttaccaaaaatccatggatgctcaagtccttgatataaaaatggcaagtatttgcaaataatctatgtacatcctcccatgtgctttaaatcatctctagtttactcacaatacctcatacaatgtaagtgctctgtaaatacttgttatactctattttccatttgtatttttattgtattggtt

SEQ ID NO: 90643 - DNA, 446 bp, Homo sapiens
ccagctcattgacaaatgagaacatggtggttcagagtgggaagttaattttcctagagacacatagctggcaagagggagcctcactgggttcggcactagatcctgtcccggacacgccttgctcatgattctgctctacgcatcttgtgtcccggtttcagcgtcctaatgacggtaatgtggaggtgtcattaggccagctcaacacttgctttccttatgaggctcatttcctgcccgggaacaccctgagactttcggaggttggaaaataaatcctcacgggatcttttttttccttaccatttattgtttcgtgaaggtttcctcccttaacacatttgtattaaagatgtttttacattagagctcgcaaaaatacttgaattgcttggtgacaagaaactaaggcatggaacaattcttattaactttgcctttta

SEQ ID NO: 90644 - DNA, 888 bp, Homo sapiens
tatttctaatattttgctactttaagcaattctgtaatggttatccttgcatgtaccttttacaaatctttaactagatttttaaatcctattgcatctgtaatcccagctactcgggtggctggggcaggagttttgcttgaaatctggaggcggaggctgcagtgagccaagatctcaccactacattccagcctgggcaacagagcgagattttgtctctaaattaattaattaattaaatgtgcaactagtcatattgctcctggctccagtgatttttttaaatcatttagaataaagtccagtcctcagtgtggtctacagggcctccatatgacctagaccctggctttctacagcctcactcttgctcactgcactgagctacactggccggcctccttgctgttctttcaaaacaggcttgtgtctactcccagagtcttctcacttgctctttcttccttctggaatgttcccccacctccccgatttgcacgagtagcttctttacattgttcagatctctgctcaaactaaggtcattcctgatcaccctatccaaaataggaaactttcttccctgtctctgtactctgctttactctttttttttttaacatttaaaaagttgagataaaatttatatgccataaaatttacccttctaaagcttacaattcagtggtttttaatatactcagagttatgcatccatcattcctaattccagaatgttttcataaccccagaaagaaacctcatatccattaataatcactcctcatccccctacccctagaatccactaatgtacttcctgtctctacagatgtacctattttgaacatttcatataaatggaataatacaacatgtagcctt

SEQ ID NO: 90645 - DNA, 438 bp, Homo sapiens
gagatggagtctcgctctgtcacccaggctgcagtgcagtggcaggatctcggctcactgaactccagtgttgggagtttacaagaaacgaaggctcagggaaggctgaacgttaccatgctagatttaactattggcatgaatattttggtctttccttcttcctgagtatccaggaaagtatattttccagccccttgcagttaagcagggccatgtggttagcccagccaatgaaatgtgggtggaagtgatgggtgccacttcctggctgaagcaggaagagactttctgtaattatccagtctctttctctttcttgccctgatggtggtagacgaggctgtgttgaggtcctggaaccataagttccaagtggttcctcgcattgctacgtggccacacctgtagcagatttgcatgacgccaaaggaactt

SEQ ID NO: 90646 - DNA, 494 bp, Homo sapiens
atgtaattaatctataaaggacatttaaaaccagtaagaaaaatgctaatattccagtggaaaaaagagacaataataccttcaaaaaatttacatgagcaacataaatggaccaaaaaaattataaattataaatcaaagtaataaaaattaaagccatgagtttatttttaacccacaaaatatcaacaattaattaaacaaccatttttattgctagcaagggtgtggagtgatataaagcactcgtttgatgctgctggggcataattagcagagcctttctggagggcacttggtaatctgtaccaagagctttagaaatgctcattcatttttacctgttgattctacttccagaaattggtatcagaatccatgatgtaaacaaagagttatgtacaagaataatcatatctactagcacaaacttagaaaaaaaccttgtatctattaacagaggtttgcttaataaattatatcaattatgaaca

SEQ ID NO: 90647 - DNA, 302 bp, Homo sapiens
cctgtctctaccaaaaaaattgaaagaattaaaaaaaaaaaaaaaaaagaactcttaaaattcaataataaaggcagaggcgggcagatcacctgacccactccccttgtttaagggaaacttttgctattaattttatgcttgatttaagcctattagtttcagattgttgcctgacaattgagttccctgtttgtttttccaaattactggctagttcattttatgtgaactttttttagaaataaaagcactgtcaagttagaattcatttatcagtttgtcacacgaaactggctcca

SEQ ID NO: 90648 - DNA, 626 bp, Homo sapiens
gatgagtcggtcctgatgctttatgggcctcattctaattcagaaagcttgtataaagaactaagactcttctgtttaataaaatagcaacaatctaatatctagattggtagtcctgcggtgccactagtgggagatgagagaattatgacgacgaggaaccgccgaggatcctctacaatagtccagctggcgtcctgccttcttgctgctggccgtcgtacaacgtcgtcatgactgggggtctttttaataatagcaattctgactggtataagatgatatctcattgtggttttgacttgcatttctctcatggttagtgatgttgagcattttttcatgtgcctgttggccatttgtatgtcttcttttgaaaaatgtctcatgtcttttgctcactttttaatgggattatttgtggggtttttttgtttgatttccttgtaaattctggatgttcgttccttgtcaggtgaatagtttgcaaatattttcttccattctgcaggttgtctcttcactctgttatttcttttgctgtacagaagctttttagtttaattaagtcccatttctctatttttgtttctgtgcttttgaggtctttgtcataaatgctttgc

SEQ ID NO: 90649 - DNA, 157 bp, Homo sapiens
aaaatcactacctctaacaaaaatagtattaatttatctttaaaattctttagttgaaaaagcttctattggcttataattattacccagaatcattcctagggcttaaacggtgttttcttcttaaagcctcgtgaaagcaatttcttagttctct

SEQ ID NO: 90650 - DNA, 275 bp, Homo sapiens
agaattctcactttaaaatgtttaaacaatagtgcttagttaagctccaacactctgctagtttcttggggttgccataacaaattactacaaactcgtgatttaaaacaaacaccattctctcacaattctggagactagaagtctgaagttaaggtgacaggagggcctcagtctctctgaaggatttagggaaggatccttcctttccctcttccagcatctggtggccccaggggctccttgattggtggtagcataactctgatctcttt

SEQ ID NO: 90651 - DNA, 472 bp, Homo sapiens
ccctccgccccctcgcggcgagatgcctcgttccccgggcttctcccgccctccgccgatctcctccctctgttgaaagctgcccgggaaagtggtggcgggagcgggcccaggcccgaatgtggcgtgggctcaggtgtctggtgtcgggcgccggaggaggttcgcgctggggtttggtgattcggaggcctggggtgcagacgcggcgtggctgtgaggcccgggcgggcgtgcgggtgtgagggccggactcacactgggccgccgcggggctgtttccatcggtcactggattttctcctcttccggttcgggcctcagggtgccgacatgacggccagggtcagagccccctcgcgccgctgttggagactttggaagacccttctgcctcccatggagggcagactgacgcttacctgactctgaccagtcgtatgactggagaagaaggaaaagaagtaattac

SEQ ID NO: 90652 - DNA, 331 bp, Homo sapiens
taacctccttctacgcctaacaacttttacagtgagtaaattctgtacaatctgaattccttgattgtgaaaaaatgtccccagggccacccattgggaggcctcccatacacttactaatccaacacagcttagaggccttgacagctccagcggtgctgcttagacaccccccttatgaatatgcaaagacaatctttcacttacaaaagaaactgatatagccattatggcctgtggttaatcaaacctccattcacttccctctgctttgagaaccgtcatcaagaaaatgtgttgctaagcaaacttagcagtaaggacctggttc

SEQ ID NO: 90653 - DNA, 702 bp, Homo sapiens
atttgtttcccttttccctgaacctccaataggaaaaatgatagtaaaaaatcagttgtggagacctaatcttaatacttagagtttaaattccaatccatacaccaggggcaaagagcaaagaagttgtgtctgtcacttaaaaaaacaaaacaaaaaactgattgagatgatccctgtagtgcttttaaagtgacaaatattttaccattttctctcatttttatcacacatgccgatgcggtagtattcctcgtctcttagagcttctggtagccccaagtgttcctttgcttgtggcaccataattcagtctctccctccatcttccacgtggccaccttccgtgtgtgtttctgtcttcatgtgacattttcctcttacaaagacaccagtcagcggaggggggagggatagcatttggagatatacctaatgttaaataacgagttactgggtacagcacaccaacatggcacatgtatgcgtatgtaactaacctgcacattgtgcacatgtaccctaaaacttaaagtataataaaatggttaagatggtaaattgtatgctatatgtatttaccacagttaaaaaattggagaaaaaatccttggaatatagtagatgcaggttcaaatcctgccttcagcatttattagctgaactgatgctaataaagttacttaatctgaaaaaaattta

SEQ ID NO: 90654 - DNA, 581 bp, Homo sapiens
actactccggaggctgaggcaggagaatggcgtgaacctgggaggcggaggttgcagtgagctgagagcatgccactgcactccagcctgggggacagagcaagactccgtctcaaaaaaaaaagaaaagaaaaagaaataacttacataacccttaggaactcttacttcaggctttaaaaggcaaggagcaaatagttttaggagactgataacgatgtcacctaaatttgagatactaaaaagagattagtgctctcaactatgtgaaatctatttctcctactgtctcaaatataatcctaggaatgtgcttataaacaaagcatttctgggccaggatagcaatgcttcacatcatattgtgctgcagtttccatcatgcttaaacgacagagacatgaacgataaataaaggtataaaaatattacaacctaccacctcaaaaacaaaaaaatcacattatttatggagttcagagcttggagattcaagtattggttacagttttattttgaaaagaatcctacaatttatgtggtttttatttctcatgtttatattaaaagaaaagctaata

SEQ ID NO: 90655 - DNA, 208 bp, Homo sapiens
gcgggagaccccgtatcctccagctgcttccggtggcccttcctcaggtcatgtcccgcagtcccctgcctctgaaccgcgctctcgcgagtttccgtagccttcgcgtccttcctccccagctctgattcgcctttatgtggagattcccctaggccttggtacatccccagaattgaccatcgttcctcatcgttacctagagtat

SEQ ID NO: 90656 - DNA, 311 bp, Homo sapiens
aaaaaaatttttaatttaaatttaaaaaagagacctcctgtaatccacaacccctcgtcctgggccccagcccccaacacacacacacacacacacacacacacactatgctgttctgtcctacttttttctcaaacatcccatgctcccttgtccccaggccttttggtgctgttccctctgcttggaacttgttcccttccccctccctctccttatctaggtaagtcctactcattcttcagattaaatttcattcatttcttccatgggaaaacttccatgagtcactcctaccctgcttcaggcca

SEQ ID NO: 90657 - DNA, 107 bp, Homo sapiens
ccatgctttccacaggagtctcaaagagctgtgtgatccaagaaaggctgagaaccacctgctgccatggactctgacaaaacatggaatgggccgacattatggag

SEQ ID NO: 90658 - DNA, 485 bp, Homo sapiens
tgccacgtcttggccaggcacagaacgtggctttgggattcaagtggttctgagtgagaatacggcgttgccatttacaccatggaggccagagtagggcagctttataatgctggctccctcgggtttccatttcctcatctataaaatgggaataaagagtgcctacttcttaggattatggtttagatctcatggattggtggatgtgactattcagctcacttagctctctgagcctcgcaggcccatgatcaattactaggaaagtaccttccagtacctgcctcgaagaacttttgtaagagccatgaggacagagactacgttttgcctttcaccacgacctggcatggtgcctggcatgaattaatcaccctgcaaatgtcggtctactggtcttttctgtttgtgtgagactgataagaagagtgggtgggtgggtggatctggcctaagaggggaagagtggggaaggtaggtgg

SEQ ID NO: 90659 - DNA, 329 bp, Homo sapiens
agctgagccttaaaggtctgggtaggagacagggggcgaggcaaacaaaggcacattcctagaaccttgcgaagtgtggttcatggacgagcagcacctgcttcacccgggagcttgctcaaaatacagattctcagtcccacccagacccactggatcagaatctgcattcgaacaactgggaggtttgggtgcagatgaaagtctgaggagctcaggacagatgatctctgctatctctgagaaatgcctttgtggcaaaggaaggaaggaagaagagataacctccccatgtgtttgggccaatgacaaggtcatatagatgtgcc

SEQ ID NO: 90660 - DNA, 364 bp, Homo sapiens
aagatccttcgtttgccctcccaactcattctgggcctttccccacctttgacctgtgaggctggtcaatatgggctgcaatcgagggctcccttgctgtctggcatctggttaggtttaaccagggggagcactagcaggaactagagggaaggagaatggagaggttagcatatgtgttctcccggctccctccttgcaaggtcacccaggttggctctgtctctctactaaaagtcacagcttcattcaggtgtcctctccacactgttctttctgtttccatgttctagtgactgctccctcccctagcttgccctcctttcccctatagggtactgtgccatcccttgtggttttgcta

SEQ ID NO: 90661 - DNA, 838 bp, Homo sapiens
gatattcttcaaagtgactgacttatctggggaaggaacattggacttagtgatgcagtagaatgttgaagtgctacatttaaaacatggcatttcaaaccagtgaggaaaagatggactgttatttaaatgatgataggacaactgctgagtcatgtggaaaaacaaagtgctaaatgctttcccgaccttattctttatgcaaaaccagatgggcatatggttcacagacggagatgtaaaaagaaagaatgaaaagaaggaaacattttaaaaagtaggaaaaaatgtaggtttcttatttaaaacaattgtggaatgaaaaggtttttaaagcatgatgttaaatcaagatgcaatagtggaaaaaaactgataaataacaaattagaacattatttttaatttaatagacataaatatatacacacatatatacatataagttaaagagcactttacataatataaaaagagtatttatggccaggcgcaatcgctcacgcctgtaatgccagcactgtgggaggccgaggcaggcagatcatctgaggtcaggagtttgaggccagcctgaccagtatggtgaaaccccatctctactaaaaaaattgcaaattaaggccaggtgcagtggctcacacctgtaatcccagcactttgggaggccgaggcaggtggatcacaagctcaggagattgagatcatcctggctaacacggtgaaaccctgtctatactaaaaaaatacaaaaacaaaattagccaggtgtagtggcaggcacctgtagtcccagctattcaggaggctgaggccggagaatgacgtgaacctggga

SEQ ID NO: 90662 - DNA, 412 bp, Homo sapiens
agataaaggaaaaccacgggtggatatgcataagaaaaacaaacagagcccaggagaagcctttggtctcagtgggatcctggctcatggaaccctctggaagctcaagtttgcagagggccctttgccagcctgtctggggccttgtagccactggttagtcttggaatccctttgcactcctataattactatacagatccttcctgacttacactggggctacatgctgataaacccctcatgaattgaaaatatcataagtcaaaaatgcatttaatgcgtcaaatctactgagcaccatagcttagtctagcctaccctaaacatgatcagacctcttaaattagtctacacttgggcaaaataaatcaaagactgttttataataaattgttgactatctcataga

SEQ ID NO: 90663 - DNA, 376 bp, Homo sapiens
tcaagggcaccagagtgaatgaacttaaggaatagtcaacaactatctttaggaatctccatgtcaaagatacctgggcagggaaatatattgtgacatgggatgggaatttgaccacttctcctgggatattaaagggaagtgccacaatgaagcaggagcacttgggacatctggatattaattccaaggagggaccttcgtggtttctctaaaaggccatcttatccagctgctgcttggatatttgtaatcatccttttgtcttgtcggatgggactatttactagaaaattcttccagtgaaagataaatttgggctcttgacctgccttttcctagctacctctttgtattctcttccgttctgcacttt

SEQ ID NO: 90664 - DNA, 229 bp, Homo sapiens
taactatgaattaaattagattatgtcaaatcatcatttaataacaagctaattttcacattactgagcaatgttaagaaatggttaagaaagtgaggtgcacatctggtagtgattctggctttttagacctttctcagtgaaaaggacggatatattatcttccctcaaatcgccatgctctctcatacagcacacaaccaatccctaacggtaatcagaagttaca

SEQ ID NO: 90665 - DNA, 695 bp, Homo sapiens
caatgagccgagatcgcgccactgcactccagcctgggcgacagagcgagactctgtctcaaaaaaaagaagaagaatttcttggccaggcacagtggctcacatctgtaatcctactaatactttgggaggctgtggcgggtggatcgcttgggaccagcctggccaacatggtgaaaccctgtctctactaaaaatacaaaaatgagggtgtggcacacaacagtaatttcagcctctcaggaggcttaggcacaagaatctcttgaacttgggaggcagaggttgcagtgagctgagatcgcgcctctgcactcgagcctgggcaacaaagcaagactctgtttcaaaaaaaaaaaaaaaaagtttgtgaattagaaataattttgaactttcagaatttttcagccaggtgcagtggcttacgcctgtaatgccatcacgttgggaggccaaggtgggcagatcacttgaggtcaggagttcaagacctgcccggccaacatgacgaaaccccatctctactaaaaatacaaaagctagccaggagaggtggcgtgtgcctgtaatcccagctacttgggtggctaaggcaggagaatcgcttgagcctgggagacggaggttacaatgagttgagattgcgccactgcactccagcctgggcaacagagcgagactccatcttaatttaa

SEQ ID NO: 90666 - DNA, 557 bp, Homo sapiens
agattttcatcatgcattccattggtgtgaaaacgaaagtaagctgctgcttggttccagttgtgctgaaatttctgctaaaaatagcacaagggggaaaaaagaacttgatgattacatgtctttttttgtttttttttttttgtatttcagcttttgttttgttttgttttgttgttgttgttgttgttgttgttgttttggtcagtgtagccacagctagaaaggagtaatttcaaaaatgttttagatatatgcttggcacatggttctttaacatttataaaagtagattgtgcataatgacagattttaaatactgtaagcattattagatgatataattgttcttttgctgtaaatttaaatatgtatacatttttgtagagttaaaatatgccaatttagttttcctttggtatatattgcctttttggaaaataaatggttaacatttcaaatagataaacaacgtcactattttatgcttaacctccatgtttgtggattatttaaataaatgattaagtgcctatgaatatctccttgcaccaaga

SEQ ID NO: 90667 - DNA, 484 bp, Homo sapiens
gacagcatccctaaccagatactgaacctgttggcaccttgatcttaaacttctcagcctctggaattgtcagaaaaaaatttctgtctttcaggaattacccagtatcaagcatattcttacagcagcacaaactaagacagggaggcttttgctatctctcctctgaattgtcacaattatcttcgaaatggtctttctactttcactttcatggctttccaataattctcaatacaaatgcatgattacataaacatttgctcaagaacctgtataaaaagactggtggatagtgactagatcctcaggatatgcagggctcaagagaaatgaaatatcttggggatatggttacttaagacgtgatactgtcacagtgaatttcacagaagatggtgctgccctaactgaggttcaatccatgtataagccagaccaatctgaagacaaataaagtatttcacagccacaaaaaaaattg

SEQ ID NO: 90668 - DNA, 429 bp, Homo sapiens
  misc_feature (426)..(426): n is a, c, g, or t
  misc_feature (429)..(429): n is a, c, g, or t
aagatacaaaatattcactatcaaaatgtcctcactgacaaaaatgttctcaaatatttctgtctcaaagttgcattgttcagtaaggaagcaaagtaggtgagacatatacaccaacaacatccctaataaaaaacttagctcatccctataagcccggaagcaaataaatcacccttacatacgttaattactttccaatttcaaattctcaactgtgaaataaagggctgttttatttggctgctgccagctcaaaatgacacattgcaccatgtgtggcatttgggccctgtttggcagtgatgactgcctttctgttcagtgtctgagtgctacgaagattgtacacagaggtccaatcttccggagaggtccaatcttccggagaggtccaatcttccggagaggtccaatcttccggangan

SEQ ID NO: 90669 - DNA, 1294 bp, Homo sapiens
gaattcggctcgagatgaaagatcctcagtctcttgtggatttagaatcctgcagcagcccaccatctaagagcaagagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcgtgctcaaatccgccttttctgttggcatcacaaccagctacccagaagaaagactacctattatatttaacaaggtcctcttcaacgagggagagcactacaaccctgccacagggaagttcatctgtgctttcccagggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattatagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttcaaaaaatata

SEQ ID NO: 90670 - DNA, 1443 bp, Homo sapiens
aacttcgtacaacagcatgagctccaagcttcaaacgcattctcatgctcagacgagcactttatttttcatcaagttattttttgcattgttttggagtagcttcgaataataaacacatatttctgctttaaatttttaatagttaactacattcatgggacaaccaaagcaagaaagcctcatgttttgggggaaagtttgatatcagcaatgtccagacaagagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcgtgctcaaatccgccttttctgttggcatcacaaccagctacccagaagaaagactacctattatatttaacaaggtcctcttcaacgagggagagcactacaaccctgccacagggaagttcatctgtgctttcccagggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattatagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttcaaaaaatata

SEQ ID NO: 90671 - DNA, 164 bp, Homo sapiens
tttatctcctcccaactcaatagtactctcaatatcctacaattctgaggtgcagattcctttttgagctctctcttgatgttaccagaacatatggaattatagtgttgtcaggtgttttcttgttaagataattcattgatatatcttcaaaggagtttttt

SEQ ID NO: 90672 - DNA, 114 bp, Homo sapiens
aataagaaacattttaatacaagaaaggccatcaatttctcttttaacaaactactctcaactctcaacaaactcccaacaaccaactctcccacagtacccagtaacaccttt

SEQ ID NO: 90673 - DNA, 373 bp, Homo sapiens
gtaaaatcattttattctatttgagatacaatgttaaatatgtttgtttctatgagttagctcccattgatgaattctgatgagttcctggatacagtagagtaattcttctggaaacaacaagtttggcatgaggagaagagtctaaggggaatgtaagagagttgaatggaatgttttggtccctgaggggttatgagttcctaaaaatactagggctaaaatatgctataaaaagctctagagggcagggtgctatacccacacctgcataaaatgggatttgcccattctaaccaaaggttattaccatcatcactggaattattctctaaaactacatttcttttcttttactagatagaatacagct

SEQ ID NO: 90674 - DNA, 667 bp, Homo sapiens
ctggaggaaaggtatctcttgacacaggtgatcttgtctaggctcagaaatggaggtaacatgagaaagcagtgattaagtagctactgacgaggttcacattaaatgatgaatgaactggccaggagttaagaagaaagtgtttaagagtgtttggctcagggtaagaatacattttactgctaatcaaccactaacttgagcccttgtgaccttgagcctcaggttgcaaaatgttatctgtaaaacaaattgttatacatgtgtaagttgctgctattgatatgcttttatttaaggccaaattttgtttaggagggtgatgggagaagggttaggacccttgcttaattagctcagctgcattcctctaatgctgaatttcccaacctagacacctttgacattttaggccgaacattttgttgtcggtggctgtcctgggcattgtaggatgtttagcagcatccttgactttcattcactagatgtttttaggaccctcttcagttgtgacatacaaaaatgtctctgacatagccaaatgtcttctagggggcaccagcctgccccagctctgcattttgagaaccactgctttgataaaagagctgagagataactctatctacgtctagagtttcccatggagttatcataagactta

SEQ ID NO: 90675 - DNA, 360 bp, Homo sapiens
ctttcccaggcttactctcccaataaatgtgctagagctctgaaaaaaaaaaaaaaaaaaaagctcggctttaggtatacatattaatgtctctctctctccttacagcctgtacactcgctaagggtaagtgttcatctttgtgttctcaaagctgctttagaagagcaccaggatcatagcaatggcatgatgcatccctgttgagacaatgaatgagtaataatttgtaatatattttaccaccccaaaaatgctctaaaacagaactaaagataggcattcctattgcttagctgatagaggaggggaaaaaatctaagacatgcaccatctcttcaaaatatacacagtttcaag

SEQ ID NO: 90676 - DNA, 312 bp, Homo sapiens
ttgcactccagcccgggcgacagtgcgagactctgtccaaaaaaaaaaaaaaaaaaaaaattcctcttcggtggctttccaaatctatggaaagcgtactgcttcctgttaattcctattcctctccaaaaatgcttgtaatatttttaatagtatggttgtgtatatccattttagcactggtgcaatcttaattaaggttgtagaaaaagtatagaatttgtggaacgttgtgtaactttgagaatccttatgactgcattttaaagaattaacaacaaggaataactagtaattttttcagctatagag

SEQ ID NO: 90677 - DNA, 4152 bp, Homo sapiens
  misc_feature (647)..(647): n is a, c, g, or t
  misc_feature (654)..(656): n is a, c, g, or t
  misc_feature (661)..(661): n is a, c, g, or t
  misc_feature (666)..(666): n is a, c, g, or t
  misc_feature (673)..(673): n is a, c, g, or t
  misc_feature (677)..(677): n is a, c, g, or t
  misc_feature (684)..(684): n is a, c, g, or t
  misc_feature (686)..(687): n is a, c, g, or t
  misc_feature (696)..(696): n is a, c, g, or t
  misc_feature (699)..(699): n is a, c, g, or t
  misc_feature (703)..(703): n is a, c, g, or t
  misc_feature (709)..(711): n is a, c, g, or t
  misc_feature (714)..(714): n is a, c, g, or t
  misc_feature (718)..(719): n is a, c, g, or t
  misc_feature (1638)..(1638): n is a, c, g, or t
  misc_feature (1736)..(1736): n is a, c, g, or t
  misc_feature (2112)..(2112): n is a, c, g, or t
  misc_feature (3535)..(3535): n is a, c, g, or t
gacatgctagtgctcggcccacccttctgtttttgtagccaaggcttgattggattttctgtatgtataatgggctgtttcaaaatggtcttgcctcattgtttcttcatatcttattgaaaccaacccactgttgatctcaatctgtgtaaggagaatgcggagtatggcattcgcaggactgaatccctagattttaagtttggaaggagatccaaccgggcagatgaattgaccggtggtgaatattctgtagcattttcctccctggagaggaatgccgccaccgctgggaaccgtggactggcatgtgagccagtggctgtgaaaggcgctgtgccctgtgtcctccgtgtactttagagcaggagcgtcacacatggtggagccgggtgatatcccgggcaggctcccgaaagctcctggtggcccatcaggggctggtttttccacctttttttttttttttttttcctcgagacaaggtctcactctgtcacccaggcaggagtgcagtggcatgatcttgactcactgcaacctttgcctcctgggttcaagcaattctcgttccttagcctcccgagtagctggcattacaggcactcgtcaccatgcccggctcgttttttttttttgtatttttngtagagnnngggtntcacnatgttgnccangctggtntnnaactcctgnccncaantgatcnnnccncctnngcctcccaaagtgctgggattacaggtgtgagccaccacgctggccctcctcagcttttttttttttttaaataaccattattattccatattttttctatgaaatcatttataaacataaaatatcttaagtctgtaattcagtttatgatacatattcagttatgatacattctttgcatttcactgtttcatgtttcagccaaatcccatccccccaacctttttttttttttttttgagccagggactctctgtcgcccagactgtagtacagtggcatgatctcggctcaccgcagcctcttcctattaaagtactgggattataggtgtgagccaccgtgtctggcccctatccctctattaagtgcctttcagcaattctgtttttagaggaaaattcctttttgcttctgcttgctccttttaccacccctgcccatgaaagggggagttacctgtccagagcaagtatagctttggccgtgatcttcaaggactattgcattggtgctgactgctggggccccttggcccccaggttcccaccagtggagcaaacacgaagggtgcagcctagtcggaagtgttcccaaggacaacatcagtgtgcagacttccaggggaggggcatatgaaactgagccaacagaggccaagatgagaaccctcctgtgacatggtcccacccattaggccattcccttggtcagctggatggcaaatactagtagtgtatgctatggagcagacatttattaagtccctgctgtgtgtcaaggattgagctaggactctgcaggaaatgcatgtgtagttcagtcctggaagctgcccagcttccgcctcctggaagcatccttttctccccagctgctctcgcctgcacatcttacattctctggctggtccttctnggtgtgttcagccactttgagctgtgcctgcctgatctgcacactttgcaaatgtgtagactcagaaagagaaacagcccaaacagtggccagaaacngttcttggaggctctaggttgacaaaagggtcctttaatagctccaggttgacccctcccctagacacctgtgctccccctgagccacaccgtgacttcggaagttcaactgtcatccagtttggtcggctctttcacaaaataatttcactgattctgtcaggcattttcattactttgatttaaagtttttgtgtcaacctctggtactttagaatctccagatgttgaaaaacaaaatcccattggtaatgtttgttttcctttacacttatgaaaaaagcaacttttattctcgcctaaaatttattgtcgagagcacgtcttttaaagtaaaaaaatgtttgcagcatgtcatacggctctgaaatactangtaggtcgcagcttgttttgaggcataagtgacaaatatacttgtgagagatgttattcttaccctattaaagaaattagaacatggcttttgtgtctctgatactgattttatatcttcgcaaccgaatttgtgaatcccagctagagtaaaagacacacgtgatgcatgaagaaagtgaaatggttctgtttggtatttatctcatcttgatctttggcttggaagaactgataatgaaactctctttgggaggacagagagctctggggcattcatctcccaactaggtctccgaatttggtgcagttcttgaaggcaggtgggtttacacagtggtgagaagtgggaagtatgaagggtgtgatcttcgccctctttttgtatgcccgttaacaaaactcaattgttaggcgttgagtagggctattgatttctagccaacggaaacacttactgtgtaatttccaggagagagacattttcaggtgatgtggactcattccctgcagttcagaaggtaatgagcaatagtgatcaatcctgaggttatccggggtgatttcagcttgtccattgcattgattgataaatggcatgctctgaggctgattgagtgatgaccagcagcatcaaagaaaaccctcagtttgcatggcgggtattagaagtggctgccttgatgcctcctgtcatcgtttgagtggtaaagagacattctttgtatgtttataactcttgatttggggtcatggttatcatctgtactaactgcacaggtcatcccgctcccatccctttttcattctttagaatcccccacagcggtccacgccccttgccaacttccttccactatcctggttctgttgttactcctgccgactgcagtgctgttccgtgagcttcttgaatgacatcgtacagtatctccgacgcacagtacgtaccagttacagttgtcttgacaggatctcctgtgatcttttgtcccttttcagtttagctcttggtggctccataggctctcaagcatcctggacagttctctgtgggctggcgtcctgggtcagattccagggccggatgtgagctgtgccttgaccatttgaagagctcaccgaaggaggtgggaatggacggtgcaggaaagtaactcaggcacccgaggctgctgagcccagagaagaagcacctgtccttggagtattgttccaggaaatggggaggcaaccggttccagagggcagaactgggttgggagacaaggaagcacagttcttgtaaatcaagaaaatttgtaaagccacataagctgtccaccagtgagagagagcatgtacatgctgtgagctgcagtcaggccgcctggccacaaggcatgttgtggcatgctgtgggagtcggcgttgaagcatcccanagacctcttgtgcttaaacaaagctgagttattcagcacactcctagatgtggggtctgattgttggtcaaactgaaggactcgagaaaatgaggactaagtggggggatgagagacatgtgagtgggtgttgggccagtagaatgacaaaaggagcaggcccaggctctttggaagacagacctttgcccttcagggggactgggggagtgtttcctggcaggtgtggacattcgtcctcatggatgtcttctttataataacctgtggaggacggcccagcgcatcatgccactgaccttcactgatgcttctgtacttaagaagtaatgtcccttggctgggcgcggtggctcatgcttgtaatcccagcactttgggagctggaggtgggcgaatcacctgaggtcaggagttcaagaccagcctgggcaacatggcgaaaccccgtctctactaaaaatacaaaaattaaccgggcatggtggcaggctataatcccaggtactcgggaggctgaggcgggagactcgcttgaacccaggagttggaagttgcagggagctgagatcacaccactgcactctagcctgggtgacagaacgagactctgtctc

SEQ ID NO: 90678 - DNA, 374 bp, Homo sapiens
atggatttacaaacactggtaagatggatgttgatcatctcaggcaggctggccacagatcctgttatatttggctcttaaagccttttgcttcctctggctgcaagtggaaggagtggatggggttcctcatgcccatgttgctgtaacttggcttccacattttacagtgaaaccaactacaggaaagtagcaaccacagcctgagtatttcctgtttaaagatttggtgtttacaaaaaaaaaaaaggtattaggttgtcatttttttctaaatctaaaattattctaaaattaaaagtttactttaaaaaatgcaatgttagctgggcgcagtgactcacacctgtaatcccagcactttgggaggccaa

SEQ ID NO: 90679 - DNA, 443 bp, Homo sapiens
ctaatcccagctgcttaggaggataaggcaggagaatcgcttgaacttgggaggcagaggttgcagtgagccaagatcgcaccattgcactccatcctgggtgacaagagcaaaactccgtctccaaaaaaaaacagaaattgggatttcaacctggcctgactccagaggaaatgctttcctcctgtaccttatggccatctcgagtaggaaatagactgtgtctttgatatgtgaggtgcaggtttgttggatttggggggcattggttgtgaagattgggggcaaggtagaaaggaagtgttgactttcacatcagctgttcatcttgaggttctgggggcctagccaggccaagctggcgagggcagagcaggaagctcagggcagcagcaggggtgagtggggcagagtctgagaagcaaatgtgagggtcagaatga

SEQ ID NO: 90680 - DNA, 163 bp, Homo sapiens
ggtagtagaagtaactgaataacagccatcactttggttgagcttaagttgtgcataggtgctcttccagacacctcatgtgtattattaactttataatcctcaccaccaaatgaggtaggtactattattatccatattttaaagatgagaaagcagaagt

SEQ ID NO: 90681 - DNA, 773 bp, Homo sapiens
gactggaaaggaaaatgggagaacttttgggggtgatggaaatgttctgtgtcatggttagtgggaatgtatacgtttgtcaaaattcatcaaattgtgtcactgtaaagaatgcattttattgcaaaccaaatgagaaaagcaaagtcgattgagaacttgctgtagcaagggagtcagccaccatcccttatgttttagcagaggttcaaaggcatgcagaggagtgggaaagctttacagtggacaaaaggaaaggtttcacaggtatgcctgattggaagctgttggcatggggaagctggaagctaactacaagttggcatcctatggtcttggttaaaggagcatatttggctttctctggatgggcataagctagaagtgaggacaaaaagtagggaagctgtcaagttttaatcaagtcctggccattttgagctgattgtcatagaagttattatttagcttcctggattgctaccagagatagcagtctgacttcctacaagtctggttgatagcaggtttggctttcaggctgagagtacacttatggtaaataagtggttggtttactgggctagttgttgtaggtaatgggtcagaattctgtttttatgtatattctggccatttaccatttgtattttcagtctctcaaaaataaattttagagacatgggagccagcttgaaggatctcccagggggcaaatttagggcaattttagcgtcaaaaagaaaatgaatacaattgattgcaaatactga

SEQ ID NO: 90682 - DNA, 410 bp, Homo sapiens
tattctaagagagtgggaagctactgaaaaacaactgggttacagatggggaataaatgcaatgatcagatttacatttcagaaacattactccagctatactgtggaccatactttggagagaacaaatcttcatttggccatactgaatggagaatagttaggagaatgactaagttagaaattatgatggcctgacttaggttatggcaatcaatgaagatggaaaaaaaaatgacatacagttgattctcattattcccaggttccatatttgcaaattcacctactcattaacatttatttgtaaagcaaaattaatgcttcctatttcacagtcatttggatgagtgtcgagtggtgaaaattttgagtaatccaacacatacattcccagctgtggtggcaca

SEQ ID NO: 90683 - DNA, 2845 bp, Homo sapiens
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcactgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttc

SEQ ID NO: 90684 - DNA, 1914 bp, Homo sapiens
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcactgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttc

SEQ ID NO: 90685 - DNA, 307 bp, Homo sapiens
aagttatctgcatagaaaactcaaagaattgacatacaaactgataaaactgagaactcagcagttttgctgagaacaagctcaagtatacaaaaatcaattgtatacattagctaaaaaaattagcaagtagttctaaaaagatactatatgcactagcaataaaaacttaaaggtgtctaggaataaacttttatggagaaatgtatgaaactttattaaaatacataaaagaagaggaaaaaatctagagaaaggaagggctgggtgatagctcctgttcattagtgaaaagaatcaatattat

SEQ ID NO: 90686 - DNA, 459 bp, Homo sapiens
gagagtagaatattttcttgtccatcatttctcttctatttagggctcttgttggggagaataagtatacggagctctagggtctgatgaacataatacattttttgtgcttgggtctcacataagcttcattgaagcctctgatatgttttctcaaggtgatagtatatattagggtttagcactaacatacatttattcaacaaatatttgagtgtccaccaaatgcaaggttctgcgctcagcatggggtaagcaaaaccagatacagtacttgccctcatgtagtacagggtccagtgggggaggcaagatatagtccaaagatcacatcaataggctgggcgcagtggctcacgcctgcaatcccagcactttgggaggctgaggcaggcagattacctgaggtcaggagttcaagaccagcctgaccaacatggaaaaaccccatctgtacta

SEQ ID NO: 90687 - DNA, 2981 bp, Homo sapiens
ctttatttcctttagggtttaatgaagaaattcattcgatgttctacacgtgtaactgtgggaactattaaaaaatttctaagtttaaaactaaaacttccaagttcttatgagttggatgtgctgtgcaatggtgaaattatggggaaggatcatactatggaattcatctacatgacaagatggcgactaagaggcgaatttcggtgtctgaactgctcagcttcgcaagtctgctctcaggatggccctttgtatcagtcataccctatggtactgcagtatcgaccaagaattgatttcggttagaccaaggggcccagacctcactgagatgaatcctgcactatttgtttactcgtcaacagattgcacagttaacggtgtgtggactagaggaacacaaccagattttcagcatgcaaataaggccattgtctatctctaaattgtcagttgcattcatgttgtttctattaggagcaaaccaagtgccattctgctactgaaccatctgcataaggtatttgtgttgtctcaaagtgtgcaagtcatggtaaaaatcagttagctgtgccgccatgattcacccttctgaatattttgcttgcctgttccaagattgttctaatgtttaattacactagtaaaatggctcaatttttgtggtgttgcagttttcacatacttactcttttattcttgtttaaatagcgtactctacaagaaactaataattatatcttgaaattattttgtatggaaatatatttagaaaagtggtttttgagccactgtcttgttcttgataagctttttgtgtgaaaaaaagttcattcttgagtgtgcaagtccttttgccaagaattccaattattctgtaacattagagcacaatataattgtagacattctaagcatctgtccgtgtagtctaccaattgcacaaggaaggcatgttagccctccagattgaaaatgtatgtgacctcttgaactgaagttagattcccaaccattcaaaatgttggcagctgatcacatttacttctgataaaagtaatgtgtaagtaaggttaatcttctttcataatgccttatgacaagcaggtgctgcttcatgaaacgtcattgtatagcccatttcatgtatcattacattgttgctgttatttaatgagtgcattatttctctttttaagttggccttaggtatatgtcattgtggcatgcagagggttatgacgattttaaatattaggatttttagagcacataacattagctattttatggatttcaaaagtctcaaaacagttgtagattaaaactgttagttacctttcacatttccaaactatgtgcataaaatagaataaatgcagtatagaactatgctaaccaaaattaataggttaagggtattttattttaaatcctgtagtaattggggaaatgagaagattattattttatacatgagttcattaagatcagaaatacaaaatgtcctgtattttgcagttttgttaagtcttccattcgttttaggattagtctgcaagtcaaagaaagtcttgttaccttaaattatatgaaaactgtcattttaaatcttttaatatttacagttttcaaaaaccttacttggaaattgctttgaaacaaacaagctaacctttgaaacttaggaaaaaatcttgaaagttaggaaaaatatttgagaaatatgacgagcacaatctgtgtgttacacacatttagtttttatactgcatatgtggtaaatgtgtcacattttccagtaaaatgtatcagaaatcaatgccttctgaatttcaaaatgattcttagaaataagatattgtacaactctagcaaacatacaaagtacagctaaatcttaatatatttcactatgtaaaaggctgaaacttcataattatctgttccttctatctttttttgagtcaaaaagtctattaaatttttctgttgttgttccaactttggtgaaaaaggttatggcaatactttaactttgttttgttacattgttttgttcttggaatggctcacaagcagaatttaaaaggcagattttcattaactataaatggctgaaaaaactgaatttactatctagctacagaaattatttttctatggtgtgaaactgttcccagacatccctaagaacttttacaaattattataaatttgtcacacctaggtcagcgattaaaatagtgttttgcaaatggaattttaattaactcaaaatgaattaagagtgcattttaaaaatcacaagtgagactttgatgttttggccccccagccaaaacttaatggtcataaatgaattttatctacaaaatctctttaaatttggctggttgccttgtcatatgtaatttcactattttccaaggaaatatataggaagcaattatgaaactgagaatagttttatatagaattcttttatttactgataatgcattaacatttttattgaaatgcaatggaatatgtgccaaaacacgtgaaaagcttacataaagaaaggcatcagttgtcgtttggagaaaggtacacatttttttgatggtcctaagtgatatggtattactactagaatcacagatttcttcaactgacttattttggtatattcaactacagctttctaaggataggactactttcatgtctagtaatacactgtattccccgttaattatcccttaagtcagattgtagaatttgcaagaaactaggtatagaaaaaatgtacaggcaacttttgtggttagctttataaatttagggtgcttataaaatgataaaatgaattctttaaataacctataggaatcatctgaatctgtaacatcagagactaaaactaaaagttttctttaatctgttgtttcttaagcaataaactgaaagacctttacttccataaaaaaaat

SEQ ID NO: 90688 - DNA, 2873 bp, Homo sapiens
ctttatttcctttagggtttaatgaagaaattcattcgatgttctacacgtgtaactgtgggaactattaaaaaatttctaagtttaaaactaaaacttccaagttcttatgagttggatgtgctgtgcaatggtgaaattatggggaaggatcatactatggaattcatctacatgacaagatggcgactaagaggcgaaaccaaggggcccagacctcactgagatgaatcctgcactatttgtttactcgtcaacagattgcacagttaacggtgtgtggactagaggaacacaaccagattttcagcatgcaaataaggccattgtctatctctaaattgtcagttgcattcatgttgtttctattaggagcaaaccaagtgccattctgctactgaaccatctgcataaggtatttgtgttgtctcaaagtgtgcaagtcatggtaaaaatcagttagctgtgccgccatgattcacccttctgaatattttgcttgcctgttccaagattgttctaatgtttaattacactagtaaaatggctcaatttttgtggtgttgcagttttcacatacttactcttttattcttgtttaaatagcgtactctacaagaaactaataattatatcttgaaattattttgtatggaaatatatttagaaaagtggtttttgagccactgtcttgttcttgataagctttttgtgtgaaaaaaagttcattcttgagtgtgcaagtccttttgccaagaattccaattattctgtaacattagagcacaatataattgtagacattctaagcatctgtccgtgtagtctaccaattgcacaaggaaggcatgttagccctccagattgaaaatgtatgtgacctcttgaactgaagttagattcccaaccattcaaaatgttggcagctgatcacatttacttctgataaaagtaatgtgtaagtaaggttaatcttctttcataatgccttatgacaagcaggtgctgcttcatgaaacgtcattgtatagcccatttcatgtatcattacattgttgctgttatttaatgagtgcattatttctctttttaagttggccttaggtatatgtcattgtggcatgcagagggttatgacgattttaaatattaggatttttagagcacataacattagctattttatggatttcaaaagtctcaaaacagttgtagattaaaactgttagttacctttcacatttccaaactatgtgcataaaatagaataaatgcagtatagaactatgctaaccaaaattaataggttaagggtattttattttaaatcctgtagtaattggggaaatgagaagattattattttatacatgagttcattaagatcagaaatacaaaatgtcctgtattttgcagttttgttaagtcttccattcgttttaggattagtctgcaagtcaaagaaagtcttgttaccttaaattatatgaaaactgtcattttaaatcttttaatatttacagttttcaaaaaccttacttggaaattgctttgaaacaaacaagctaacctttgaaacttaggaaaaaatcttgaaagttaggaaaaatatttgagaaatatgacgagcacaatctgtgtgttacacacatttagtttttatactgcatatgtggtaaatgtgtcacattttccagtaaaatgtatcagaaatcaatgccttctgaatttcaaaatgattcttagaaataagatattgtacaactctagcaaacatacaaagtacagctaaatcttaatatatttcactatgtaaaaggctgaaacttcataattatctgttccttctatctttttttgagtcaaaaagtctattaaatttttctgttgttgttccaactttggtgaaaaaggttatggcaatactttaactttgttttgttacattgttttgttcttggaatggctcacaagcagaatttaaaaggcagattttcattaactataaatggctgaaaaaactgaatttactatctagctacagaaattatttttctatggtgtgaaactgttcccagacatccctaagaacttttacaaattattataaatttgtcacacctaggtcagcgattaaaatagtgttttgcaaatggaattttaattaactcaaaatgaattaagagtgcattttaaaaatcacaagtgagactttgatgttttggccccccagccaaaacttaatggtcataaatgaattttatctacaaaatctctttaaatttggctggttgccttgtcatatgtaatttcactattttccaaggaaatatataggaagcaattatgaaactgagaatagttttatatagaattcttttatttactgataatgcattaacatttttattgaaatgcaatggaatatgtgccaaaacacgtgaaaagcttacataaagaaaggcatcagttgtcgtttggagaaaggtacacatttttttgatggtcctaagtgatatggtattactactagaatcacagatttcttcaactgacttattttggtatattcaactacagctttctaaggataggactactttcatgtctagtaatacactgtattccccgttaattatcccttaagtcagattgtagaatttgcaagaaactaggtatagaaaaaatgtacaggcaacttttgtggttagctttataaatttagggtgcttataaaatgataaaatgaattctttaaataacctataggaatcatctgaatctgtaacatcagagactaaaactaaaagttttctttaatctgttgtttcttaagcaataaactgaaagacctttacttccataaaaaaaat

SEQ ID NO: 90689 - DNA, 393 bp, Homo sapiens
ggcctggagatttgcattctcacaaccacattgagttcaaacctttcctgcattttttccagatttactacatcttgaatgaaaatgagaaacacttttcttggtgcagaaatagatccttggctcaaaaagttaagtccaatgtcgaggagatgatctgtgccatctgaaaggacgcgcccagctcctgagagagctgcaatattcctatttgaatgaggaaattgcctccttattcaaattccacttcccctttgcacgttctctcagaacatgaatcctttaaggtaagatgttcatttaaaatgcacacatttggtcgggcgcagtggctcacacctgttatttcagcactttgggaggcctaggcaggcggatcacctgaggtctgga

SEQ ID NO: 90690 - DNA, 496 bp, Homo sapiens
aaattgaccacggctggggctggaaagtaggaaaaatgcttaaggccaggagttaaaagactagcctgggagaccctgtctgtgtgcgcgtgcacacacacacacatacatgcaaattctggaatgggtggtgaggaatttttaaaagaaaatttaattttaccaaagaagttacacaggtggcaaataaaaacattaaaaaatgctcaatatcaggaagttttagggaaatgcaatgaaaaccacagtgagataccactattcatacattcaaagagctaaaataaaaaagattagccacatgaagcactggcagggatgtaaaggaactgggactctcatacacccttggtgggactacaataggaaacatccatttagatcaaatttggcatttcttaaaatgttaaacattcacctacattgtaactaagacattacagtttgagttattaacacgaggaaaataaaacacatatccatataaagaaatgaa

SEQ ID NO: 90691 - DNA, 309 bp, Homo sapiens
agtttgaaggggatcccttctctacagaatttgggatattctctattgttgctaaacgtccagcacatactaatcaactctgattagaaaatttaaatgccccattttcttcttctctgggatacttcaccatacatacatatagacaaacttatatataaatgtgtatttgtgtgtgtgtatatatatataaatacccatacatgcatataatgtttgttctaaaggttctctgtagtttttccctgttttctccttctgcccactgtttcctatcttatcaccatcactgaattgccaggcagacat

SEQ ID NO: 90692 - DNA, 324 bp, Homo sapiens
ccatgcttagaagggccctgttcttggtttaatgctctactattgccttcttaatcatatttgaacaaggagttctgcttttccttttgccctttaaattagatagccagtcctggtgctaactaaccacttttctaggtattatccctttagttttcactgaaaccctgagataagttatattgccctagttttcacagttcaggaaatggaagctcacagaggtcaggtaacttgtccaagctcccatagttcttatatttacatgctggtggagccagcatgtgaatataagaagtctgaccctagagccttattcttaat

SEQ ID NO: 90693 - DNA, 652 bp, Homo sapiens
tcagtgatggtgctgtgaattctttgtaagtgaagtgtcccctcagcatgccagggttctgttaaatcagttaatgctgttccctgcttctctggttcattgattgtagtttggggatatagatatttcttttatttaagatggagtttatttttgtttcttatcctccttattgcttgggagaaatgtcacaaatttgttgtaagatttaaaattagactctttgagtactataaatttttcatcaaacatatgcagaaaaagaatagaaatgaaaataaatgggctggatgtggtagctcacacctgtaatcccagcacttttgggaggcctactcaggcagattgcttgaggctaggagtttcagaccagccagggcatttctacaaaaaatacaaaaaaaaattagctgggtatgatgatgtgcacctgttgtcccagctcctcaggaggctgaggcagaaggatcacctgagctggggagatcaagtctgcagtgagctggcctgggcggcagagcaagaccatgtctcagaaaaaaaaaattgggcttcattttctactatttcaggccaagtgtctttcaatagggagatctgctttatcttccttcccagttatttattctgtcagtggttcccaggttttttt

SEQ ID NO: 90694 - DNA, 943 bp, Homo sapiens
ctcttgacttgggctattctccttacagtttcttgcaaggttttcctaaaatgcacatctgatcatgtcacatcctcttttaaaatctgttaagtctctctgctgcctttaggataaaatgtaaaatcttttgcctggaatgtgaggctgtccctggcttagtgctagctgagacctctagcctgggaggccctcttgcaatctgaacccatccatttcacacttctgcctgcaagtcccttcatacctctccccatccacactggctcagaggctaccattgagacagccagatgggagggggtccccggaaaaactccaaccagcctgcccactagggtagagccttgggaagtttgtgctgtttgcagagggggcggggtggtggtgggggagccaggccccctcctcttcctgtgtgaaacctggaattcgaactatgaggcaggaagctctctagcaggggactctggccttgcagggagtccctgtttcccccttttcttcctttcacccagcaaaaccctgtcttactcattcaaattgtctgcgagcctgaattttcattgccgtgggacaaaggaccccatctttagctgaactaaggaaaagtcctgcaacaccatctttccctagctgctctgacagtcagcttctatagctgcattatgagttttcctaccctcagactgaactctatgaagaaatgggctgtgtctttttttctatacagacccagggcctagcccactgccatatttaataaacaaatgtatcgaccatttgtgtcaacaaatatttttattttttactttgatgagtgaatctcctggccttgtgtgaatttcatcttacagtgaagattattactaggagttctaatctctttcaaggtctacatatccattgcacatcaattttcttcttgaaagctcccagattt

SEQ ID NO: 90695 - DNA, 4161 bp, Homo sapiens
caggaatatcttgttttctttaatccatcagggggttgtcgcacttattaagtcccacagctgcagtttagcacggaggggctgtcacgtcaccaggcctccctgaaagtcctccgctccagctctgcgattggcgctggggtaacaggaggggaagcgggtgcttttcatcgagcctgcaagaggggggcccaggcatcgaggctggggagtcgtgggtagagccccgattccagccaagacgccacaggacataagtaagcgtggagggcaaaatgactacccaagcgcaattctgtaaggccgaagggacgttcttccaacctcttaaatttcccgggtgccacgcccctcaattgacggccctggattccaaggtgtcgcgccggaagtgacctcacggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactg

SEQ ID NO: 90696 - DNA, 4332 bp, Homo sapiens
caggaatatcttgttttctttaatccatcagggggttgtcgcacttattaagtcccacagctgcagtttagcacggaggggctgtcacgtcaccaggcctccctgaaagtcctccgctccagctctgcgattggcgctggggtaacaggaggggaagcgggtgcttttcatcgagcctgcaagaggggggcccaggcatcgaggctggggagtcgtgggtagagccccgattccagccaagacgccacaggacataagtaagcgtggagggcaaaatgactacccaagcgcaattctgtaaggccgaagggacgttcttccaacctcttaaatttcccgggtgccacgcccctcaattgacggccctggattccaaggtgtcgcgccggaagtgacctcacggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggagggtcttgctgtgttgcccagcctggtcttgaattcctggactcaagtgatgctcctgccttggcttcccaaactcctggaattacaactcaatgaatgacggtttttgttgctccacatcctcgtcagcatttggtgttgtcagtgttttggatttcggccattctgacagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactg

SEQ ID NO: 90697 - DNA, 3554 bp, Homo sapiens
  misc_feature (5)..(5): n is a, c, g, or t
ccggnctgctcaggtctccaaaatcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactg

SEQ ID NO: 90698 - DNA, 3826 bp, Homo sapiens
caggaatatcttgttttctttaatccatcagggggttgtcgcacttattaagtcccacagctgcagtttagcacggaggggctgtcacgtcaccaggcctccctgaaagtcctccgctccagctctgcgattggcgctggggtaacaggaggggaagcgggtgcttttcatcgagcctgcaagaggggggcccaggcatcgaggctggggagtcgtgggtagagccccgattccagccaagacgccacaggacataagtaagcgtggagggcaaaatgactacccaagcgcaattctgtaaggccgaagggacgttcttccaacctcttaaatttcccgggtgccacgcccctcaattgacggccctggattccaaggtgtcgcgccggaagtgacctcacggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctgactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactg

SEQ ID NO: 90699 - DNA, 4250 bp, Homo sapiens
caggaatatcttgttttctttaatccatcagggggttgtcgcacttattaagtcccacagctgcagtttagcacggaggggctgtcacgtcaccaggcctccctgaaagtcctccgctccagctctgcgattggcgctggggtaacaggaggggaagcgggtgcttttcatcgagcctgcaagaggggggcccaggcatcgaggctggggagtcgtgggtagagccccgattccagccaagacgccacaggacataagtaagcgtggagggcaaaatgactacccaagcgcaattctgtaaggccgaagggacgttcttccaacctcttaaatttcccgggtgccacgcccctcaattgacggccctggattccaaggtgtcgcgccggaagtgacctcacggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggagggtcttgctgtgttgcccagcctggtcttgaattcctggactcaagtgatgctcctgccttggcttcccaaactcctggaattacaacttggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactg

SEQ ID NO: 90700 - DNA, 4465 bp, Homo sapiens
caggaatatcttgttttctttaatccatcagggggttgtcgcacttattaagtcccacagctgcagtttagcacggaggggctgtcacgtcaccaggcctccctgaaagtcctccgctccagctctgcgattggcgctggggtaacaggaggggaagcgggtgcttttcatcgagcctgcaagaggggggcccaggcatcgaggctggggagtcgtgggtagagccccgattccagccaagacgccacaggacataagtaagcgtggagggcaaaatgactacccaagcgcaattctgtaaggccgaagggacgttcttccaacctcttaaatttcccgggtgccacgcccctcaattgacggccctggattccaaggtgtcgcgccggaagtgacctcacggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggaggctttcaggtataggctgggtcactagtcttaaaacatttcttcttgagaatgtctaaaagactgtggaatctgttagatcttatatacttttaagttggcacctgaaacttttcatcctagatttacatagtggtcttgctgtgttgcccagcctggtcttgaattcctggactcaagtgatgctcctgccttggcttcccaaactcctggaattacaactcaatgaatgacggtttttgttgctccacatcctcgtcagcatttggtgttgtcagtgttttggatttcggccattctgacagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactg

SEQ ID NO: 90701 - DNA, 3658 bp, Homo sapiens
caggaatatcttgttttctttaatccatcagggggttgtcgcacttattaagtcccacagctgcagtttagcacggaggggctgtcacgtcaccaggcctccctgaaagtcctccgctccagctctgcgattggcgctggggtaacaggaggggaagcgggtgcttttcatcgagcctgcaagaggggggcccaggcatcgaggctggggagtcgtgggtagagccccgattccagccaagacgccacaggacataagtaagcgtggagggcaaaatgactacccaagcgcaattctgtaaggccgaagggacgttcttccaacctcttaaatttcccgggtgccacgcccctcaattgacggccctggattccaaggtgtcgcgccggaagtgacctcacggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggaggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactg

SEQ ID NO: 90702 - DNA, 222 bp, Homo sapiens
tcaaggacctttggctgtttaaggacacattcaaatgcctaaccatagcgttcagtgttctcaacactgggccttagtttaaattttggttccagcttctggcccgtttgccctgtggtcccctgtgtattttagccgcatctctctgtgaagctcccagtgtgctttgcacagctccttgtctttgctcatgctgtgcccttacctggaatgcctttttcc

SEQ ID NO: 90703 - DNA, 192 bp, Homo sapiens
ttaaacagcaacccacccttattagatatcccacttccaaagtcatctcccctcccttccccagatgtttcaccatgtcccttgtctcagctgttagcagtagggagtggtggggggccatgcgcgtaggggagtcatgtgactcaggctaggccaatcgcactatttccctgagaagttaaactatgtcat

SEQ ID NO: 90704 - DNA, 369 bp, Homo sapiens
aagttcctgcccaacagtagtcccggctaccgaggaggctgaggcagcggtaggatcccttgagcatgggagctagtctgcagcctaggcaacatagtaagagcaggttaatattttaacctggccgggtgtggtggctcacacctgtaatcccagcactttgggaggccgagacgggcggatcacctgaggtcgggagttcaagagcagcctgacaaacatggagaaaccccatctctactaaaaatacaaaattagccaggcgtggtggcacatgcttgtaatcctagctgcttgggaagctgaggcaggagaattgcttgaacccgggaggcggaggttgcagtaagccgagatcacgccattgca

SEQ ID NO: 90705 - DNA, 440 bp, Homo sapiens
caggaaaaccctccttgcagggagctcatcttccgcctttcaaaacttcagggcgctcctcaggcatcgcacagggtaacggcttggacagcagcagcactggctgttcacaagcatcttgtggtttttcagagccctgtcctgccgcttggggcagcacttcctcccgccgggccctctcccttcctctctccagacgcctagtcctcacatgggcaccttccctttcctcaccctccagggtcgcccaaatcccatagcccttatcacgtgctgtggatgccaacacgcagccaagccactgtttctggggagcaaccaggggatcgggcagcccaggtaaaggctgcggtcccagagctgtgggaagggaggggacaggacaagaaggaaaggaaggaaaagcgtgcggaacctgcagtgcaattgttgggggaagc

SEQ ID NO: 90706 - DNA, 298 bp, Homo sapiens
tgataagcctagaagtattttcttttaagctatattgaacaaaaatgtttaaactgcataaaagtgcttgaatttatagtgtccatccaaacattgagaaatatgagccatacacatgtgtatgggggtcatgggctgttccttgtttatttttaccccgttcagacaaaaaaggtatttgacaattttgcccaagtggtttcttgccctctctagtgtttcttttgaaggacatcaggagataaacgtatttgttactggctcttcattagtgcaagttaatgctgtctcacatttg

SEQ ID NO: 90707 - DNA, 277 bp, Homo sapiens
tcccattgaatcagcatgatttttggcatttattaaatatattcaaggcataaaacatgatgttttgatgtacatatacatagtagcacgattactacactcaggctctcgtatatccattatctcacgtaattacctctttttttttcttttgtggtaagagcatttaaaatctactctctgcaaatttccagtacatcacatttcagaaatttaaaaaaaatcacatccatttctctaaaatatccaagagagattgttatattgttataaataa

SEQ ID NO: 90708 - DNA, 325 bp, Homo sapiens
ttttaagaaatatgcttcatttttataatgaaagtggataatctttagaatttgttgtaattagctttcatttattgtaaatgaatatggatgacatatcatatgataattcattttagaagttcagtcactctgtgagtaatctaagcccatccttgggctgttcaccaagtggtttacactctggaaaaagcatcagtttggttttaaacaaaggagatactatacagcaaaaagctcagagccttattttaaggcaaggaagtttaatccccttttcctaactaatcattgaatctagttgccttagaaataatatgcctta

SEQ ID NO: 90709 - DNA, 657 bp, Homo sapiens
  misc_feature (1)..(7): n is a, c, g, or t
  misc_feature (9)..(9): n is a, c, g, or t
nnnnnnntntatgtagagagatatagtatagcttttattttttttttgaaccaacccaacatttccactggcaactgtcaacatagcttatgacatgagcactgtttcttttttaattatttttttcttaaaaaatgtgtttaaaattaacaggtgttttttaatttcttcccccccccccttagaaaatgtatttatgtcaatgcagaaagcctaaagatccgtgggcagtttcgtgatgacatcttatgtctgtttatttgtgtgtttgtgtgcgtgttttaaagccaggtccttcccacattcgttgagaaaaggtctgtagggcacggagatctctttctccaaaaacccaggctccaagggattatgacaactaagattcctcttactggagcaagaactaccccataggctggaaaaatagcttcatgaagtttaagaacaagcaggaacatgggagaaatgaggaattccagttcctatcttgtaaaaatgctttcatatgtgacctgagggaccaggagaggtgaagggagcccctggttctcttataaaatctctaagtttttacaccacttcaagaaatatagtcagccctctttgtatagagcattaggaagcaagagcgtggtgaagctgacatttctcaggcac

SEQ ID NO: 90710 - DNA, 701 bp, Homo sapiens
gggccccttttgtgttgttcttgccaacgcagcagccatcctgctatatagactggctgtgcagccgcaggccccatcacactgaactcgcatcatccgtgtcaaccagccatggggaagatcaccttctatgaggacagggccttccagggccgcagctacgaaaccaccactgactgccccaacctgcagccgtatttcagccgctgcaactccatccgggtggagagcggctgctggatgctctatgagcgtcccaactaccaaggtcaacaatacttgctgcggcgaggggagtaccccgactaccagcaatggatgggcctcagcgactccatccgctcctgttgtctcatcccccaaacagtctcccacaggctgcggctgtacgagagggaagaccacaaaggcctcatgatggagctgagtgaagactgccccagcatccaggaccgcttccacctcagcgagatccgttccctccacgtgctggagggctgctgggtcctctacgagctgcccaactaccgggggcggcaatacctgctgaggccccaagagtacaggcggtgccaggactggggggccatggatgctaaggcaggctctttgcggagagtggtggatttgtattaaaatagcttaacactaccaatttcccattttggaacctaataaatatttagtctgcattgctggca

SEQ ID NO: 90711 - DNA, 647 bp, Homo sapiens
ccaccacaaccagcatcgtcaagtagcatacataaacgccgcgcgaccataattcccccctttactatcaccttctatgaggacagggccttccagggccgcagctacgaaaccaccactgactgccccaacctgcagccgtatttcagccgctgcaactccatccgggtggagagcggctgctggatgctctatgagcgtcccaactaccaaggtcaacaatacttgctgcggcgaggggagtaccccgactaccagcaatggatgggcctcagcgactccatccgctcctgttgtctcatcccccaaacagtctcccacaggctgcggctgtacgagagggaagaccacaaaggcctcatgatggagctgagtgaagactgccccagcatccaggaccgcttccacctcagcgagatccgttccctccacgtgctggagggctgctgggtcctctacgagctgcccaactaccgggggcggcaatacctgctgaggccccaagagtacaggcggtgccaggactggggggccatggatgctaaggcaggctctttgcggagagtggtggatttgtattaaaatagcttaacactaccaatttcccattttggaacctaataaatatttagtctgcattgctggca

SEQ ID NO: 90712 - DNA, 162 bp, Homo sapiens
tgaacacttaggttgcttttgactttttacaattaaaaatgaattattctgcgcttcagtgaataatcctgatcatacatccttgttcacatgtccctagaagggaaacactggggctcaaagcatgcacatttaaaaatctgttttggccaggcatggtgg

SEQ ID NO: 90713 - DNA, 417 bp, Homo sapiens
tcaaggggaccagactaccggacaagtaaatgctctcccttggccaggctctgccatctagcttgggttctttttgcctcctctttgacaatacagaaaatctcaccataccagatagcgcttctcaggcaatgtcttcaggaaagggaaagggagttcacagcaccacacagtgggcaaccccactattcccagagccatacctccagacagctccaggtttccctcaccaggctgatcggagagggcaccaatttcaatcattgccaaatgctaacatctaaatgttttggaaccaagtctatcatttttgtccagcattagagaagacgggggcataatggaaagggttgtgatctagaaagtggaggattgtggaatagtttctggttcatgctgtcctcatttataaaatga

SEQ ID NO: 90714 - DNA, 449 bp, Homo sapiens
cttaattgcagtgagacatggaaatgtcacttgtttatagctctattctctttcccccttattgtaatacatattacatctatatatgttacaaacccatcatactttgttataattattactttatataattttatgtctcttaagcttagagaagacagtagacagatattatttacaatgtttattatattaaccttcttagttactgtttctggttctcttctttattcctgtgaattcaagttaccatctggtgtcattttcttggtccattgcagttttgctcccactcaccttcttggtgttgctggcaaatatattacatttctatatattatgggcctagtgatacaattatatacatattgttttattacagttgcatttttaaatcagttaagaaaggagaaggaatatacatttaaactgtcttttttaactacata

SEQ ID NO: 90715 - DNA, 346 bp, Homo sapiens
cttcatctctgtgtgccaagtagtgtttccctaaatagatttattacaatgcttctattcgcctgttgttggacatttgggatgtttcaagtttttggcaataaataaaggtaccatgaatatttgtgtaaatatctttatatggatacatgctttcatttatcttcagtaaatacctaggagtggaatgactaggtagtttatgaagtgtatatttaattcctaaagaaactaccaaagtgttcaaatcttttgatcatttttataactgatttgtactgtattaacaagttgagttctttatatactctgaatgaagttgattctcatatatatataatgaaca

SEQ ID NO: 90716 - DNA, 291 bp, Homo sapiens
gcagctttcattttacacataaaaaccacggaccttccaaatagagacaatccatgcagaggaggaatgagacagacaagaggctagagcagaagacgcaggttatgggctcagcagtacactggtcaagtgggagaatgggatctctaaggatgtgggtgcagttttatgccaggaattaccattttaattccattatctgcccaaatcatctgttgtcttataaataacagaaatctgtttttcacagttctggtggccaaagtctgagatcagagtgccagcacgctt

SEQ ID NO: 90717 - DNA, 366 bp, Homo sapiens
gactcatactgtgtatattgttttataaactgttttttaattcaataacatatcttgaatttccaagtctaccagacttttctacagaatcaatttaaataattatggtctatcataaatatattactcttctcctatagctggacatttaggttgtttccaatgtttacccttataaacaatgccactatgagcaaccttataggtaaatctttctacaaatttttgacattttcctggagatagatttctgggccatagaaattgaggttgatttggggtggggggagttggtaagatttacctgtaaaggttgatttggggggtggggagttggtaagatttacctgtaatgcattaacttcc

SEQ ID NO: 90718 - DNA, 391 bp, Homo sapiens
gagccacattcttcccaaggcaacagggccagcttgcgtattagagtctggttaaggccttgcttgactccccttattcctacctcctggctcttcaggccacatggagagagatggccatcagtctcccttctctttagggactcattttgtgaaggaaagccatttcccacatagtttatggcaaagacaggacaggactagtcttagccacagtcacagaaaagagaaaatgtctttgttactttcttagctagcaaaacccatttcccagcctcttgatgtactcaaagcctaacctactctttttttttttttttttttttttttttttttttttttttatattccctcgagaggtaacccggttggatttgggacttgcggcctc

SEQ ID NO: 90719 - DNA, 360 bp, Homo sapiens
  misc_feature (66)..(66): n is a, c, g, or t
actctgcaccactggctgggaacaaatacatgctaacaaattcacacacaaaatcctgaatcatanggaaaattctagttagcctggaacacaggaagatatgcctttataccaacacgacctataaataactgacccaaagtgaatgtaccacaaagtaaaaggttttaattaattataaaaaccaaaagcaaaaaaagttgtttcaaaacagaccaacgtctttcatatcaacaaatattaagccaggaaattgacattgcttcaatccacggagcctattcagagttcatcagttttatatgaattcctttgagtgggttttatatttctgtgcaattttatcgcctgtagctttgt

SEQ ID NO: 90720 - DNA, 3253 bp, Homo sapiens
  misc_feature (1247)..(1247): n is a, c, g, or t
ggcgtggcctacatctccgctgtcctttccatctccttcgcccaccccttggccttcctcacgctcctgcccacctccatcagccagttcttctccggagctgtcctgggttctgaaatgttcgtcatcctcatgctctacctctggttcgccatcggcctggcctgcgccggcttctgctgccaccagctgctgttgatcctccgcgggcagaccctgccaccaggtgcggaagggggtggcagtgagggcccggaccctggcgcaagaacttacaagaggtcttcggaaagaggtggctgctgggcctgctggtccccatgttcaatgtcggaagtgagagctccaagcagcaggataagtagtagacactcccgtcagtttatctctctgtctctgtcttgactcctcctgagcataaaaccatggcagccttgtctccacccatgactcactacaaccttgtgctggtaaggtcctagcatcttcccctcaccttccacccatgagaacagcgtgagctggtggatcatgacaaggaggaaaaatgtccccccaggcatttctaggctcctcacgagccagccaggtggctgctagctgttaggctgcctctgctttctttccgtccccttgggatccctgctttccccctcttcctggctcatccattctccaccgtgtctcattcatcactgctgtctgctagagcccttcctctcagcccccatgttgggagaggggagtggattcttgctgctggtatgagactccctgggacctagaggctggcaaatgtttaaaatcaccacgtgtaagaggcagccaagtcagctctgccaactgctaggggagttgggaaagagtgggtgtgtgtccgcatcccctctgtaggaaaaagaacttagtagcttgctgctccctcaccaccccccaccaggttcaagaccctttttctgggagacagcaatcaatggcctgctttttccaaatgttattccctgtccgccctgccccatctggccggcccagcccagtccaggacctggctggatgcttcctgtccctggaactcttccagcctttctacttgatctccagcccccaggtctttgccagatgatgggaaggcaaggaagaagggacagggaaagataattactgataaatgaaggggatattcgactgtataaccatatggaagtgtgtgtgtgtgtgtgtgtgtgtgtgtgtgtgtgtgtgtgtgngagagagagagagagagagagagagatgggtggtggtgagaagtgttgttagaaacatataggaataatgcctaggggaaagggagaagtgagagggacaattgggttcatttatgccctatacaaagggcattccagcagctgaaactcttcaatgtttgaatggctgcctgtgaaggtagtgagtgccccatcactggaggtattccagcagagtctaggcagtcgtctgccaggcatgctgtggaagggatttctgtacagggtcattctaggtgagcttacacattccttccaaccccaaggttctgatgtcctggttgtgattgctggacccagaggcaagatctgcagagatgcctgtgagatatttgctttcctagaggggagtgtgggcatgggaggggtctgaaaatcaggacccaacccagccactgaagagagagtctctgcagagacagggctacctgggtggttgaggggactgacatttgaggacagggagatggagcagtgtcattgtcagtggcagggcatggggggcagtggtgagctaaggctgaggagtggagatgaccagaatataagggtgcaattcccagaccatccctgcgcatctgactgactccggtggaggcactgctgtgtgttttctgaaacctagaggaccagacccctggggcatataagggagtagggacaacacaagtgccccctcctgactgggtcccaaagccaatatgacatccatgcaggcagcagtgctgaatccatgccctgcaatgtccaaccgccaactgcagtgacccgctgatagctgcgcaacagcctgggttcttgagcagagattgggaggactttactgtggttctgccttcacaccccctagagagctaatgtagtattggctccacctgctcacatttctccctcccatactcattccttcactcatccatcctacgtatatttattgagtgccaactacgttcccagcctcttccaggcactggcaatgcagtgatgaacaggatgacaagattcatgccatcaggggcaccttgtcactgccgtctgtgcactgattcacactccctgcaaaatggtcactctgccatcttggtggttggtggggcaggtcatttggaaataaagaatgtgatagagatggctgaagaggggaagcctaggctgcctcaatggaggagtcgctgggggcattttcacccacaattctggccatacttaagcaatgggagggagagggaggaggggaagatctgggcaattttggccttgactctttcctggctccagagctcaagcttagaagccagccctgctatttccagcctcctgaaggctcagcacggtgaggcctgacatcctggggaagggcaacagggagacctacaggatgttggctgcttgcagactggtcaatgggggatgacggtggggaggttgccagatgtgagacttgagtagcatttgtacacatggccctgtattgtccttgaagaacatcaataaaatatatggttttaaattgaaaaacaaacaccaacaaaaaaaaaaaaaaaaaaagggggggggggtaaaaaatttcccgggggggcccattatgccgccgtccccaggcttttctttgttacaagaggtggcccctattaggaggaaggcggatattaaattaaagcataggggacaggggccgggactggttataacacagcggtcgggcagactggggggaacaaccgtggctaccgcttgcgggagactccttcggggagaaagggaaccccttaccttctctggtgcggggcggaccacttactgttgggacaacactctctctacaaagaaaattttaagacggctctacagggacacacttttacaacatacttacagggtggttataggggtgtttaacccacagcgggaatttcgttgcggcatagaaaatttgggatcacaggattgttttgaacatttttccg

SEQ ID NO: 90721 - DNA, 1107 bp, Homo sapiens
ggcgtggcctacatctccgctgtcctttccatctccttcgcccaccccttggccttcctcacgctcctgcccacctccatcagccagttcttctccggagctgtcctgggttctgaaatgttcgtcatcctcatgctctacctctggttcgccatcggcctggcctgcgccggcttctgctgccaccagctgctgttgatcctccgcgggcagaccctgccaccaggtgcggaagggggtggcagtgagggcccggaccctggcgcaagaacttacaagaggtcttcggaaagaggtggctgctgggcctgctggtccccatgttcaatgtcggaagtgagagctccaagcagcaggataagtagtagacactcccgtcagtttatctctctgtctctgtcttgactcctcctgagcataaaaccatggcagccttgtctccacccatgactcactacaaccttgtgctggtaaggtcctagcatcttcccctcaccttccacccatgagaacagcgtgagctggtggatcatgacaaggaggaaaaatgtccccccaggcatttctaggctcctcacgagccagccaggtggctgctagctgttaggctgcctctgctttctttccgtccccttgggatccctgctttccccctcttcctggctcatccattctccaccgtgtctcattcatcactgctgtctgctagagcccttcctctcagcccccatgttgggagaggggagtggattcttgctgctggtatgagactccctgggacctagaggctggcaaatgtttaaaatcaccacgtgtaagaggcagccaagtcagctctgccaactgctaggggagttgggaaagagtgggtgtgtgtccgcatcccctctgtaggaaaaagaacttagtagcttgctgctccctcaccaccccccaccaggttcaagaccctttttctgggagacctacaggatgttggctgcttgcagactggtcaatgggggatgacggtggggaggttgccagatgtgagacttgagtagcatttgtacacatggccctgtattgtccttgaagaacatcaataaaatatatggttttaaattg

SEQ ID NO: 90722 - DNA, 1231 bp, Homo sapiens
ggcgtggcctacatctccgctgtcctttccatctccttcgcccaccccttggccttcctcacgctcctgcccacctccatcagccagttcttctccggagctgtcctgggttctgaaatgttcgtcatcctcatgctctacctctggttcgccatcggcctggcctgcgccggcttctgctgccaccagctgctgttgatcctccgcgggcagaccctgccaccaggtgcggaagggggtggcagtgagggcccggaccctggcgcaagaacttacaagaggtcttcggaaagaggtggctgctgggcctgctggtccccatgttcaatgtcggaagtgagagctccaagcagcaggataagtagtagacactcccgtcagtttatctctctgtctctgtcttgactcctcctgagcataaaaccatggcagccttgtctccacccatgactcactacaaccttgtgctggtaaggtcctagcatcttcccctcaccttccacccatgagaacagcgtgagctggtggatcatgacaaggaggaaaaatgtccccccaggcatttctaggctcctcacgagccagccaggtggctgctagctgttaggctgcctctgctttctttccgtccccttgggatccctgctttccccctcttcctggctcatccattctccaccgtgtctcattcatcactgctgtctgctagagcccttcctctcagcccccatgttgggagaggggagtggattcttgctgctggtatgagactccctgggacctagaggctggcaaatgtttaaaatcaccacgtgtaagaggcagccaagtcagctctgccaactgctaggggagttgggaaagagtgggtgtgtgtccgcatcccctctgtaggaaaaagaacttagtagcttgctgctccctcaccaccccccaccaggttcaagaccctttttctgggagacagcaatcaatggcctgctttttccaaatgttattccctgtccgccctgccccatctggccggcccacctcctgaaggctcagcacggtgaggcctgacatcctggggaagggcaacagggagacctacaggatgttggctgcttgcagactggtcaatgggggatgacggtggggaggttgccagatgtgagacttgagtagcatttgtacacatggccctgtattgtccttgaagaacatcaataaaatatatggttttaaattg

SEQ ID NO: 90723 - DNA, 2799 bp, Homo sapiens
  misc_feature (1247)..(1247): n is a, c, g, or t
ggcgtggcctacatctccgctgtcctttccatctccttcgcccaccccttggccttcctcacgctcctgcccacctccatcagccagttcttctccggagctgtcctgggttctgaaatgttcgtcatcctcatgctctacctctggttcgccatcggcctggcctgcgccggcttctgctgccaccagctgctgttgatcctccgcgggcagaccctgccaccaggtgcggaagggggtggcagtgagggcccggaccctggcgcaagaacttacaagaggtcttcggaaagaggtggctgctgggcctgctggtccccatgttcaatgtcggaagtgagagctccaagcagcaggataagtagtagacactcccgtcagtttatctctctgtctctgtcttgactcctcctgagcataaaaccatggcagccttgtctccacccatgactcactacaaccttgtgctggtaaggtcctagcatcttcccctcaccttccacccatgagaacagcgtgagctggtggatcatgacaaggaggaaaaatgtccccccaggcatttctaggctcctcacgagccagccaggtggctgctagctgttaggctgcctctgctttctttccgtccccttgggatccctgctttccccctcttcctggctcatccattctccaccgtgtctcattcatcactgctgtctgctagagcccttcctctcagcccccatgttgggagaggggagtggattcttgctgctggtatgagactccctgggacctagaggctggcaaatgtttaaaatcaccacgtgtaagaggcagccaagtcagctctgccaactgctaggggagttgggaaagagtgggtgtgtgtccgcatcccctctgtaggaaaaagaacttagtagcttgctgctccctcaccaccccccaccaggttcaagaccctttttctgggagacagcaatcaatggcctgctttttccaaatgttattccctgtccgccctgccccatctggccggcccagcccagtccaggacctggctggatgcttcctgtccctggaactcttccagcctttctacttgatctccagcccccaggtctttgccagatgatgggaaggcaaggaagaagggacagggaaagataattactgataaatgaaggggatattcgactgtataaccatatggaagtgtgtgtgtgtgtgtgtgtgtgtgtgtgtgtgtgtgtgtgtgngagagagagagagagagagagagagatgggtggtggtgagaagtgttgttagaaacatataggaataatgcctaggggaaagggagaagtgagagggacaattgggttcatttatgccctatacaaagggcattccagcagctgaaactcttcaatgtttgaatggctgcctgtgaaggtagtgagtgccccatcactggaggtattccagcagagtctaggcagtcgtctgccaggcatgctgtggaagggatttctgtacagggtcattctaggtgagcttacacattccttccaaccccaaggttctgatgtcctggttgtgattgctggacccagaggcaagatctgcagagatgcctgtgagatatttgctttcctagaggggagtgtgggcatgggaggggtctgaaaatcaggacccaacccagccactgaagagagagtctctgcagagacagggctacctgggtggttgaggggactgacatttgaggacagggagatggagcagtgtcattgtcagtggcagggcatggggggcagtggtgagctaaggctgaggagtggagatgaccagaatataagggtgcaattcccagaccatccctgcgcatctgactgactccggtggaggcactgctgtgtgttttctgaaacctagaggaccagacccctggggcatataagggagtagggacaacacaagtgccccctcctgactgggtcccaaagccaatatgacatccatgcaggcagcagtgctgaatccatgccctgcaatgtccaaccgccaactgcagtgacccgctgatagctgcgcaacagcctgggttcttgagcagagattgggaggactttactgtggttctgccttcacaccccctagagagctaatgtagtattggctccacctgctcacatttctccctcccatactcattccttcactcatccatcctacgtatatttattgagtgccaactacgttcccagcctcttccaggcactggcaatgcagtgatgaacaggatgacaagattcatgccatcaggggcaccttgtcactgccgtctgtgcactgattcacactccctgcaaaatggtcactctgccatcttggtggttggtggggcaggtcatttggaaataaagaatgtgatagagatggctgaagaggggaagcctaggctgcctcaatggaggagtcgctgggggcattttcacccacaattctggccatacttaagcaatgggagggagagggaggaggggaagatctgggcaattttggccttgactctttcctggctccagagctcaagcttagaagccagccctgctatttccagcctcctgaaggctcagcacggtgaggcctgacatcctggggaagggcaacagggagacctacaggatgttggctgcttgcagactggtcaatgggggatgacggtggggaggttgccagatgtgagacttgagtagcatttgtacacatggccctgtattgtccttgaagaacatcaataaaatatatggttttaaattg

SEQ ID NO: 90724 - DNA, 582 bp, Homo sapiens
gttgttatgaagaattaataataagatatgtaaaaccagcagcaccaatagtgcctgacaaaatataactgctcaataaataacagtgaattattataacaacagctaatggtattctattggaacacatggtctgtttcttttccaattctgagtgatctcaacagcctcacggcacattgaaaataaaagtcaacttcctcaccttccccataggccatggactttcccatctctacccacttgtgcagtttctcctctttcctctctcctcctcagttactaaagcaatcttccttcaaacacttctattttccattacatcacttcattcaggttggtgatcagctgcaacttcctcagaaagaccactgctgcttccagtgaccctggctttgtcttgctttgtattagattactcagctccctggtattattgttgtctttatcgcttattagaatgtaacccttaatgggcaagaaattgtcagtcttgttcatttatcatcgtataaaaaatgtttctagcacacagaaagtgaccaataaatatttctggaattaatgtagtaatgaatccaa

SEQ ID NO: 90725 - DNA, 447 bp, Homo sapiens
gatccgtgctgatatcagtctttccaactcagtctgaggtaaacaaaccctgcactggttgatgcaacagttatggccttccctaggacagttgccaggaaagataatgttgattcttctcagaagccatcccgaacacctctgtttttttctaaaccgggctagaatgctgtggtgggctcctagaggtgaggtagagagtgtgacacatcaggtagtgtgccacacacacacacacacacacacacacaaacacacatacacaaataaactgttcaagttatctcatttatatgaacatcaatctggagaacaggcatggggatggatattaattgtatgagattatggtgtaaggaacatagagttgtatcaggctgaatttactgattaggaccatcaaggtagtgactttgtgtttaatatggcagcttggcgagttaaaaa

SEQ ID NO: 90726 - DNA, 263 bp, Homo sapiens
  misc_feature (152)..(152): n is a, c, g, or t
aaaccatcctctttgttaaggacacatgcaaacattatttttaagatgtattaattccattaatattttatttatttttttgaggctgagttttgctatgttgtccaggctagagggcactggagtgcagtggcgcgatctcggctcactgncaagtccgcctcccaacaccctcggtctgacaaaactctttatacagctgttctataagacaggttctaggaaatccacaaaagcctgggcaacagagcgagacaccatct

SEQ ID NO: 90727 - DNA, 591 bp, Homo sapiens
gtggaaaggagaagaggagaagagattatcttcctgcattcagcttctatcaatttccttctagcaatagtgagcagactggatcagcggtttctgggagttccctcacctccagggtgggcctaatacccttttgtggtcctagaatcatggggtctccatgcaaccttctccaagattccagcccctcctttccagtctcgggctccatgaatactacattttctcttttcttctcccagccccagagttgctatgtactaatctctgggttactctactgtctctgctttgctttctcagctctcccttatgcagccactttcctatcttaaaatctctcactgaaatatgtgaaatggttttgttttcctggctagtacaccgaataaatatctttaatgtatttatattagaccttcaaaccttttgggaaaatgacattgaaaaaggatgaagtgagttttttctttttgataattcattaagaaatattctttaaatagttttggatcaaatttcaagagcattttaagaaacagaatcctcaccattgaaaaccaaacgattgtgattgtttaatgctgattt

SEQ ID NO: 90728 - DNA, 281 bp, Homo sapiens
  misc_feature (177)..(177): n is a, c, g, or t
  misc_feature (186)..(186): n is a, c, g, or t
  misc_feature (247)..(247): n is a, c, g, or t
  misc_feature (252)..(253): n is a, c, g, or t
  misc_feature (271)..(271): n is a, c, g, or t
acactattctttgccagtttattatttaataggtcttacatgtttctttcttactagcttagttctgcaaggaattaagtagcctttctctactttaagttgaaatagaaaactactccttactattttctgtatattagtctttacaaacttaaaaataatgtactcttgtaagcngcacggggngacgcagactttcctctctgcgagcttctacttctaagtctgaatccagtcagaaataagnttttnngggtaacaataaataggnccagactctg

SEQ ID NO: 90729 - DNA, 441 bp, Homo sapiens
tagaaagaacatcttactacattgcctaggccggtctcaaactcctgggctcaagcagtccttccatctcagcctcccaaactgttgggattacaggcatgaactaccatgccctgctgcttaaagttctttatatgaaaagtagagataatgggctgggcgcagtggctcatgcctgtaatcccagcactctgggaggccgaggcgggtggatcacgaggtcaggggtttgagaccagcctgaccaacatggcgaaatcccatgtctactaaaaatacaaaattagccaggcgtagtggcaggcacctgtaatcccagctactcaggaggctgaggcaagagaatcgcttgaacccaggaagcggaggttgcagtgagctgagatcactccattgcactgcagcttgggcaacaagagtgaaactttgtttcaaaaaaat

SEQ ID NO: 90730 - DNA, 689 bp, Homo sapiens
ctcaaaagtaaatatttgtggaagatacatgaaaaggaatttaatgacagaaaagtaatttttttaatttcctctctcattgcctcaatttggtatgattgttttccaaattttgggatgtctgtacaccataacttgtaaggtatgttgtcttctttacctagttttccatctctttgtttactgaattcagacctcagagaaaagtggaaaaacataatcattaaatctagcaagaagaatcattttttccattttgtttctttttaaacacaaattcttctagtggaagtaaataaggtatagtaaacattttgactgcaggttttaaaataaaatggtcagacgtagagtaactataatgtcaaaacttatgacacttataatttttacttttacctacattttaatggttcagatcttcaaatatcattgatttaaaaactaaaaggtgagtaaatttttaataaagcagacaaactaagataaacatggatgagttgcttaagagaattcactatatttttaagatctaaataagcaatatatgcttcaaaataggaatatatagagttatgatttgattccatttgggctaaattttttaacttaaagcaaaattacatagacactaattttggagtagcaaataatatagaaaaaaatgcctgcaaatgttcttttatttt

SEQ ID NO: 90731 - DNA, 563 bp, Homo sapiens
ggagacacagggagtgagaggtgggcaggagggcagacacgccaggcacgtgagggcacgcttagtgagggctggggggctggagacggtgccgaggaaccaccctgaggcccagcgctttggctccactgccctttcccgcctccgtatttctctacatttgaacagtttaaaggataaagggaaagactcaggaaatggcaaccttgccctggctctggccccaaccttgagagaatcatttccacccctaggcccttagcttctcgctgcagtccctttactttgcaatggcttataccacacacgcaggcttttgcagctgtctctgaccttctctataatactctctcatccctcttcctaccctcacccaacacacacacacacacacacacacacacagacacacacagtccatttaaaacatgtacttggatggattcagaagagaacagaagaaaattgggcctcaggatggcacaccctgcaaaggacagagacagaaggagataatgggccagagccacgccaaccctgagacctcaggccagccctcggcc

SEQ ID NO: 90732 - DNA, 928 bp, Homo sapiens
ctttcagatttttaaaaaactgctcataacacttccattgctactgctcatctccttttcacttggtaattagtcaatgctcccgtgaacatcaccagattgttaatggttggcccatgtgtctgactcatctgctcacaaagtcatctggcccatggggaattacttccatagttctatttcatgccattccacttctctgagcctcagattttcatcagtaaaatggaaagaggttttcttaattcaagatgggcttcagggatccatgggtacctgaaattgtacacagcattttgtgtgtcaggagcacatatgcatttcgtgggagaggatctatagatttttttttatcacattctccaaagggggtccatgagtcacacacaaaaagacaaaaaccactggactaaatgatctctaacgtccctcccagctctaacattctgtaagtcaaaggtcctaagacacacgacattttcttattcccttgagagggagttaaagatcaactatttctatgcctgttattcagtgacaatgaagagataaaaatctgacaaacccctagacaccatgcaacaccaactgaaaaggttagagctaaatcttttttgtctcatgaggtaatattttcctctcactggaaatgatccaacagaagtggaattatcatctctccacaatcgtatataaggaattttttaaattatgtgaagatgcctataatcacagcactttaggaggccaaggcaagaggatcgcttgagcccaggagtttgagaccagcccagcagttcaagacatagtgagaccacgtctctacaaaaaaattttaaaactagccagtgtgtagtggcttatacctgtagtcccagctactagggaggtgggaagatcacttgagccagggaggttaaggctgcag

SEQ ID NO: 90733 - DNA, 172 bp, Homo sapiens
caattatacgatatgattaattttcaagaactctttcttattctctgattattcatttttatcacagtcagttcttgctttatgagcatgataaatatgctcttgaatctccagctgaacatactgctttgaatttttatgttcttctgtctcctgggctccctgttttctc

SEQ ID NO: 90734 - DNA, 657 bp, Homo sapiens
cagagcaagcattttggagtggcctgcctgatctgttcatgaccaccatcctggtaattgtttctgctctgggccactgaacttattctttgtataaattatgaattactattaagcttaatgaagaaatgtttaactgttgggaatatacttttagtaatattaacatgaaaaggagaattggacattttcaatcaaattttcatttctctgagtgtttttgctttactctgatttttagtctggcatttaatcacatgagcggtttaccttagaatatattgctaattcatcttactactcgtaaatggagttgggaggctgttggctgagttgtcatctcatgtgtctttgaatttaattttaattttacatttcaatgttgtgacattgtataagtataaataaataaaaggccttctatttgtaaaaatcattttttgctttattttatattttattttaattcatcaccagttcatttaatgttaaagataatcttgcccagtaatgcacttggtttgtttttgaataacagatcagagaaaaaccttctgaatatttcaataattttacacaataaggttatttttggtgaagataaatagtaactataaaaataggtacagaagatacatagtttgttgtgataaatgc

SEQ ID NO: 90735 - DNA, 354 bp, Homo sapiens
cagagcaagcattttggagtggcctgcctgatctgttcatgaccaccatcctggtaattgtttctgctctgggccactgaacttattctttgtataaattatgaattactattaagcttaatgaagaaatgtttaactgttgggaatatacttttagtaatattaacatgaaaaggagaattggacattttcaatcaaattttcatttctctgagtgtttttgctttactctgatttttacaaatagaaggccttttatttatttatacttatacaatgtcacaacattgaaatgtaaaattaaaattaaattcaaagacacatgagatgacaactcagccaacagcctcccaa

SEQ ID NO: 90736 - DNA, 766 bp, Homo sapiens
gtgagctgagatcgtgccgctgcactccagcctgggcaacagagcaagactccatctcaaaataaataaataaatattttttttttttaaaaaagatcctgtggtttaaatgttgagcatgatggaaatttgaaatgtttttaacccaggtttgcttatctttttttgaaagcattacctgatttcatctgagattttctactatgcacactatttggagttcttggaaatgatgtaataacaatagtcactcctatctcctcctccacataagtccaagataccttcagctgagatgagattaagctgttgttctaacatgtggagttagctgtagcaccataaatgcaagagaattcttaatttaaattaatataaatcaacatattctttcatttgtttatgatagactataaagtactgtcttatcaggagataaggcaggctagcagttgacttggtaatatttagagatgtagtaaccaaagcaaaatgtaatattcccctgcttagaaattgctttactgggccaggcaggtggatcacattagcccaggagtttgagaccagcctggccaacatggtgaagtcccatctctactgaaaatacaaaaatgagccaggcatggtggcgcacatctgtaatcccagctacttgggaggctgaggcacgagaatctcttgaatccaggaggtggaggttgcagtaggccaagattgcaccactgcactccagcctgggcgacagaatgactctgtctcaaaa

SEQ ID NO: 90737 - DNA, 222 bp, Homo sapiens
gcaaacctgccatctcaaaacatgtgtattttaatgagacaacaaagatcaagggaactttagtccttacaatgtaatgatcaaaaaagtgaaatagataatcaacataacattgcttgtagaccatgcaaacaatcttattgcatttgtatatttgtaatgaactgttttataataacaaaatgtaaaatgtgtattttatttgtccttttattgttttcc

SEQ ID NO: 90738 - DNA, 423 bp, Homo sapiens
agctagcattaccatttttttctggaccctttcgatacattcctgtaggccatataatgtcggtaggtaaagaacttcctcattttgcattgtatttcattgtatgactgcaccatactttttcccccctactgctgatggacatttacctttcaatcctttgctgttgcaaacaatgctgcataaccttgtagcaattgtcttttcatagatctgtagagtaaattcctagaagtagaactgctggggttaaggggtttgcctgtttgtgtaattttgatagatgttgccagaataccctctggagaggtatatcagcttttatactcctaccagcaaagcatgacccaagtgaagaatgggtaggagatgggtgaagttgaggctgggtcaggtttatgagtgtgagggggactgaaagta

SEQ ID NO: 90739 - DNA, 182 bp, Homo sapiens
tttgtgtggaaagcccactcacacaccgctttccagaagtaccactttatccacacccccacatgtagagaaacctggcttgctattcccagacaacatgcagtttttccaaggactgctagtcaaaggcaaggtgaaaatcactgtcattaaatatttttaaaatacttgaaactgagaaa

SEQ ID NO: 90740 - DNA, 489 bp, Homo sapiens
cagtccagcctccctgattccacctgtttctgctactcccacaaaaaattttaagagagaaaaaacaattaaatgtttagctacactccattttctttttctttgagttattgctgtaacagtccaacaaatcattgatttcttttgaaaaaccaacgaggtaatgacaatttctgctctggaatagcttccttgttaaaagagaaaggtgttgcccctctgaatttcctattttgtcataaatttgagctgcattttactcatctttaaaataaaaataaaggtcaagtacactggcttacatctgtaatcccagcagtttaggaggctaacatgggaagatcgcttgagcccaacatttggaaaccagcctgggcaatatagtgagaccccctctctacaataaaatacaaaaattagccagttgaagttgttcacgcctgtagtcccagctacttgggaggctgaggagggagaatcacctgagcc

SEQ ID NO: 90741 - DNA, 579 bp, Homo sapiens
cagccatgtttgtagtgtggccctggccccccttggtcatatctgattggaccgtggatggacacctgactcgagctggccaatcagaacccgcaggaattgggcctcggcacgtggccgaagtgaggacatgtaacacaggcactcaccgctgggatgctgtggacctggggcacagagcaggtgtagaaggaaaggagagggaagagatgggaagagagggtcatggtattggcgtccatatttctgtactggtgcttcatgaaagctggtggcatctcttggcctggtttccctgacacctgatatcataacgaattcaggactccagctcagtgagagagtttctgctccttgcaaccaaaagcatcttcactgggaagacttgagtgccgcttgctctgtgctttgccctggttctgaactcagaacctgacctcagggatcgcttcgccactccgctgcctgtgtccatgagggtttctcgcaaaagaagttttacctttaaaacttattttcctctgattattaatgtccgtggtaataataaatgactcaatattagctttgtgccaaaca

SEQ ID NO: 90742 - DNA, 594 bp, Homo sapiens
gccaaaagatgcaatcattgctaagaggtattgtttaatactgggaaagtcacatcaaaagctttctcaaaaaatatatattttaagtcctccttccattcttcactttcctgtcttggggagacagaatacttcaaagtagtctgtttttaaaaggtgacttctttcaggttttgggaaagagtgttatgtgttgtaattaagtaattgttccctaagatagtccttaagtacaaggacatctcactagacttcattgtcttgtgaaaggagcggtatttcaggaattaactactcatttaataaagcaaaaaggctggatgtgatagctcacacctgcaatcctagcactttgggaggctgaggcagttcgatcacttgagcccaggagactagcctgggtgatatggcaaaatcctgtctctacaaaaaaatacaaaaattagctgggcatggtggcacacacctctaaccccaactagttgggtgtctgaggtaggtggattgcttgagcctaggaggtcaaggctataatgagtcatgattgcaccactgcactccagcctgggtggcagagagagagatcctgcctca

SEQ ID NO: 90743 - DNA, 581 bp, Homo sapiens
tccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctat

SEQ ID NO: 90744 - DNA, 643 bp, Homo sapiens
tgggaggaggtgggggccgccccgcgagaagaagagcgggaagaggcggacagcgaggccaagatttcagctgcgggacggtcaggggagacctccaggcgcagggaaggacgtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctca

SEQ ID NO: 90745 - DNA, 763 bp, Homo sapiens
  misc_feature (57)..(57): n is a, c, g, or t
gtggtgcgcttcgcccggtggtgcgcttcgcccggtggtgcgcttctccaggcgcanggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctcaaaaaaaaaaataacccatccaactaacaccctcctttcccgtcttctctctttt

SEQ ID NO: 90746 - DNA, 1709 bp, Homo sapiens
tgggaggaggtgggggccgccccgcgagaagaagagcgggaagaggcggacagcgaggccaagatttcagctgcgggacggtcaggggagacctccaggcgcagggaaggacggacgtgaggaggggaagcgggctggggcggcagccgggcggaggggcagctgcgcaggcggaatgaggaacgcctttgctctaaggcgaccaccctggcagctcttcactgaggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaaggagggaagattttgcctgaagcgggaaagccaagggctgggcggcgcgagacccccattcctagcgactggggctggctggtggcccgcggcagcccccgcgccgggaggattaggcctcccgccgctcccacccgtccggaccctcccacgtgtttaggtcctcccaaaagtattcggcctccggcccctgccccttcccccggctggcctggacctcggggacgtggggggaaccccgtgggagcagggggattctggacggggagggagtagcggttggggagaaggctgagcggggaaacggagagaggggctccggggacggcagggaggagagtgggtcgtgccggagacccagggagagacacaatgggcaagattaggggtgtagggtgggagtgcgaactgactgattcctagcgtgggcagggaactttgctaaaactgcaggccccagggaacagcgcgggcagggtgggagggaacggagagggccaggcggaccctaaggtcaatttggagaaagggccatttccaggctccttcacctgtgcccagcgttctacaggcctggaccccgcccccgctccccaccctccccccagagcagggcgcgggaggaggcggctcgggctggctcggagagctgaggggcgcacacccgcttcgcagggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctca

SEQ ID NO: 90747 - DNA, 697 bp, Homo sapiens
cccccgcgctgcaggaatacggcacgaggagacctccaggcgcacggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctca

SEQ ID NO: 90748 - DNA, 1940 bp, Homo sapiens
tgggaggaggtgggggccgccccgcgagaagaagagcgggaagaggcggacagcgaggccaagatttcagctgcgggacggtcaggggagacctccaggcgcagggaaggacggacgtgaggaggggaagcgggctggggcggcagccgggcggaggggcagctgcgcaggcggaatgaggaacgcctttgctctaaggcgaccaccctggcagctcttcactgaggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaaggagggaagattttgcctgaagcgggaaagccaagggctgggcggcgcgagacccccattcctagcgactggggctggctggtggcccgcggcagcccccgcgccgggaggattaggcctcccgccgctcccacccgtccggaccctcccacgtgtttaggtcctcccaaaagtattcggcctccggcccctgccccttcccccggctggcctggacctcggggacgtggggggaaccccgtgggagcagggggattctggacggggagggagtagcggttggggagaaggctgagcggggaaacggagagaggggctccggggacggcagggaggagagtgggtcgtgccggagacccagggagagacacaatgggcaagattaggggtgtagggtgggagtgcgaactgactgattcctagcgtgggcagggaactttgctaaaactgcaggccccagggaacagcgcgggcagggtgggagggaacggagagggccaggcggaccctaaggtcaatttggagaaagggccatttccaggctccttcacctgtgcccagcgttctacaggcctggaccccgcccccgctccccaccctccccccagagcagggcgcgggaggaggcggctcgggctggctcggagagctgaggggcgcacacccgcttcgcagggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacggtgagtagcatggcccgggcaggagcggggagggtcgtaccccaggagaccagcgcattcccacgaagggggacagaagtgcttgggctctgagccccagccctttggagaaaaggccactgtccagcctgctggaatgtgactgcgtgagggaggtgcggatcacaccagggcttgctctgcaccctcagctggctaccggccatcctctgcctgcctgtctgtccgcagcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctca

SEQ ID NO: 90749 - DNA, 810 bp, Homo sapiens
tgggaggaggtgggggccgccccgcgagaagaagagcgggaagaggcggacagcgaggccaagatttcagctgcgggacggtcaggggagacctccaggcgcagggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctcaaaaaaaaaaataacccatccaactaacaccctcctttcccgtcttctctctttt

SEQ ID NO: 90750 - DNA, 637 bp, Homo sapiens
cgtgtttatgcatgtgccacacaacccatctgggaaggactcctgcctgcacacacatgaaagttccatagtttgaaaactgcatgggtctgacttctgacattctagggtggctgtgcctgaaacctgctggcctgcatgacctcttgctcctgggctcgagggcctagttggggatctggtcccatgatgggcagccctggctcccaccctcatgatgcccaggcctccctcacccttttcctctgctcaccccatgctccccgctcccccacagaggaaacggaaatgcctggcctgcatcaaactgggctctgaggacaaagttctgggccggttggtccactgccccatagagacccaagttctgcgggtaagaaggggcaagggtgcacaggtggtgacagggctgggaagatggatggaagctgagcctatgggctggtctcgaggctaaagcttggccaagcaggagggagggcagtgggggctagaaagcgctgtgcctgtttggacattctccaagggatgtggaggggatgtggaggatgctggcagccctccactggcactgcccacccctcctacactgcctgaacagttttgggcactggcaggaggctgaggagcaccagga

SEQ ID NO: 90751 - DNA, 756 bp, Homo sapiens
tgggaggaggtgggggccgccccgcgagaagaagagcgggaagaggcggacagcgaggccaagatttcagctgcgggacggtcaggggagacctccaggcgcagggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctca

SEQ ID NO: 90752 - DNA, 815 bp, Homo sapiens
tgggaggaggtgggggccgccccgcgagaagaagagcgggaagaggcggacagcgaggccaagatttcagctgcgggacggtcaggggagacctccaggcgcagggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctcaaaaaaaaataaataaataaataattaatatatcctcgctcctattcaattaaaaaaaaa

SEQ ID NO: 90753 - DNA, 259 bp, Homo sapiens
cctctgctcaccccatgctccccgctcccccacagaggaaacggaaatgcctggcctgcatcaaactgggctctgaggacaaagttctgggccggttggtccactgccccatagagacccaagttctgcgggaggctgaggagcaccaggagacccagtgcacttgggccacccgctggcccaatgcagcggctggagtagtccttgtagtgagaatacagctgtgtctaggacatgttcagccccacctcccttatgc

SEQ ID NO: 90754 - DNA, 709 bp, Homo sapiens
  misc_feature (57)..(57): n is a, c, g, or t
gtggtgcgcttcgcccggtggtgcgcttcgcccggtggtgcgcttctccaggcgcanggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctca

SEQ ID NO: 90755 - DNA, 1886 bp, Homo sapiens
tgggaggaggtgggggccgccccgcgagaagaagagcgggaagaggcggacagcgaggccaagatttcagctgcgggacggtcaggggagacctccaggcgcagggaaggacggacgtgaggaggggaagcgggctggggcggcagccgggcggaggggcagctgcgcaggcggaatgaggaacgcctttgctctaaggcgaccaccctggcagctcttcactgaggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaaggagggaagattttgcctgaagcgggaaagccaagggctgggcggcgcgagacccccattcctagcgactggggctggctggtggcccgcggcagcccccgcgccgggaggattaggcctcccgccgctcccacccgtccggaccctcccacgtgtttaggtcctcccaaaagtattcggcctccggcccctgccccttcccccggctggcctggacctcggggacgtggggggaaccccgtgggagcagggggattctggacggggagggagtagcggttggggagaaggctgagcggggaaacggagagaggggctccggggacggcagggaggagagtgggtcgtgccggagacccagggagagacacaatgggcaagattaggggtgtagggtgggagtgcgaactgactgattcctagcgtgggcagggaactttgctaaaactgcaggccccagggaacagcgcgggcagggtgggagggaacggagagggccaggcggaccctaaggtcaatttggagaaagggccatttccaggctccttcacctgtgcccagcgttctacaggcctggaccccgcccccgctccccaccctccccccagagcagggcgcgggaggaggcggctcgggctggctcggagagctgaggggcgcacacccgcttcgcagggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacggtgagtagcatggcccgggcaggagcggggagggtcgtaccccaggagaccagcgcattcccacgaagggggacagaagtgcttgggctctgagccccagccctttggagaaaccagggcttgctctgcaccctcagctggctaccggccatcctctgcctgcctgtctgtccgcagcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgcgggtggtaaccagtggaagaccccagcccccagggagaggaacccgttctatccccagccatgataataaagctgctctcccagctgcctctca

SEQ ID NO: 90756 - DNA, 268 bp, Homo sapiens
gttgaatttgtgtgcgcgcctttagccttgcttggtggatgagttggattttagtgcattttcaatcaatgtgcgtgtacacttaagcacaaggagaggtggctttgtgctgtcatcgaggattagatgtgtgatgagacccacccagctctgccctgtgccctaattctgctgctttgcctgttgaaaccttgcctgtctcgtcaccccaaattctctaaacttagcagtacttaacctttattaaaaacagcagaatcactcatga

SEQ ID NO: 90757 - DNA, 180 bp, Homo sapiens
atacctacaagtatatttggaggaaaggaagagaggaatagcaacaaggtataggcaagcaaaatcttcatctatcatagcagtaagatgacaggttttttacaatcccatattcttgggatttttacagtcccaagaatctcttcaatcccaatgtttctattgtctctgtgttggatc

SEQ ID NO: 90758 - DNA, 372 bp, Homo sapiens
tgggtaatcatctaatgctggagtcacttttgtctccacacggtctcagagaaaacccccaagtttccttagggaatctgttaagatgtttgtcacagcattgcttgtgctagtaaggcattggaggcaaactaactacccatccctgaaggaatgggaaagttaaaaggtaatagatgctcattatggagtattagacagcagttagaagccatagattacatgtaaatgcaggaacatggatggcttttggaaacatactgccaaatgaatagcaagataagaatgagattcacaccccaatgtcatataataacatgttaaaaatacatgccggaccaggcacagtggctcatgcctgtaatcccagca

SEQ ID NO: 90759 - DNA, 459 bp, Homo sapiens
ttatttggagctcatcatacacacaaaaggtgttttgtttggttgggaacgcagtgataggaaacttcattctcagagtactcataatgtaatcaggaagcaaagcctaaggaaagcaagtcactcgaggcctggactcaaatgctgacactgcgtctgttcttcctctttctcattttctctctagtctctaaaaatcttaagtcctagtccctgaagttgatcacaggtgttggaattatgaaaacaaccttcaaagaacattatgtgtgattagcttgatgctctgagaggtgttggcctccacaaagacaactctgaaaatccaaataaatctctgactgggagactgaactgtggaaaggagtctcaccacacctggagcctgctggttttccttgttcaattcaaattgctaccccactccacctcgacctgcttataccacacatgccaccc

SEQ ID NO: 90760 - DNA, 627 bp, Homo sapiens
tccaggtatccttcataagagagtcagcatggaagaaaggttaagtgggaactgttcatgcttttccttcatttgtagttccctattaaattaggcaaaccaaaaagaacattcggaaatgcttaatgctgattagactgtgatgaaaccagctcactcatacatatcacgggggactgggtcaacccatgccactgttctagacacaaaatttgaccatgtgtatcaagaatcttgaaaatatccatattcaagcctggtcatctcacttatgggaaaagaacccataaaaaagaaaaagtacaatttatggcaccatgtttcttagcacatgagacaacactatgcgtgcaccttattttatgtactatgaagaaaaaaagcaaaaccatgtgctgccatttactgtgataaaaagtaacacaggctgaaaccgatcaattgtcaggcccagccagatttcagagacattaaaatgtgagaaaacgtggtcttagaattggattaaaaaccatccaaaatggtttaaaaacatgcaaaatgcaataatgagatcatttgactccttggtaagtttcctggcctctgaacaggtgcgaatctgacgcatatagtggtaaaaaaaaa

SEQ ID NO: 90761 - DNA, 269 bp, Homo sapiens
tgtttccaaaacagcactccatttttcctcaatgaataaatggacatctagaagtaaaaattccagttcactgagaatgtgccgttcttctgcggatgacttttaggttttaaagagatctctggctgggcgcagtggctcacgcctgtaatcctggcacttggggaggctgaggcgggtggatcacctgaggttgggagttcgagaccagcatgtccaacgtggagaaaccccatctctactaaaaacacaaaattagctgggcgtgg

SEQ ID NO: 90762 - DNA, 571 bp, Homo sapiens
tggtagagatgcactctcgctatgttgcccaggctggtcttgaactcctgggctcaattgatcttcccaccttgacctccaaagtgctgggattacaggtgtgagccaccatgcctagcctcagggaattcttataagaactctatgaagtaggcatcaccatcttctctgtatccatggaaagagaggcctagagatgtatgctaacttgcccaagctcacatagcccagggtagcatagctgggatctggctgcaggcctgcttagctctgcatactcaccttcttcccagcttggggcagtgcagtgggtagcagttagccccccggtgcttgccagagaggtgccctacagggtaagagggcactgccctaagggtgcctggcgctgagaggttgggtgagaatacccagcagcttggagacaaaatgcaagggcacctccctcttctgagaagaggtcttggcttccacacccctctataccctgtatgtgtcagacatccagtggggaccagcccctgctaggccctggagatacaaaggcatccaggaggacatgcacgaggac

SEQ ID NO: 90763 - DNA, 807 bp, Homo sapiens
gagggcacaaagtgcaaaatagacatgtgaagagttaatagcttcaactattaattgaattgtatgtttgatggaagcagatgactaatagtggtcattgataatcaagtcatacaaagcagggcccttaaggccagaagctaacaaaaaaactaggtgaccaaaaagaatgagttttcctgaacatttactctggaaacccatagcatccttgctgtgcttctgaggctactgctgttagaaagctttagaaagctttttgccatggcactggtgagcttgtaaggggctaatagcattttcatagtcaccgaagattttttttaaaaccttaccagatatttagaaattacatttagaactcatattttaaattccatagaaatttaataaataagtgcatgaattattttcaattcagtatatatttttccacatttattttacttaaatcttaaaagaatagcagggcattttaagccattttctcagcaaacagtgttattgatctttctgaatatgtttcttatttaccgagatcatattttttaaagattatttttaaaagtataactatgttttagaacaaagtataatgtgtactggtcaatgaaatacaaggctgcttattttctataagaaaatgaattacattatttgattgattaaatgcagcagaaatgtaattacattatatataattaagtgcctatgaaataatattataagataagaagattgtgcaatgaaatatgacaatccttaatggaattaaggtgaaatgcattatcttgagattaagagatt

SEQ ID NO: 90764 - DNA, 193 bp, Homo sapiens
aaaaaataaaaaaagtacacattttgtgttgtccttttttgtttaataattcactttgctgagtccactttatcttttgaacctgatttagcccacagtttgagctgtggagtggtgacctggcctcttggtgagttccgggtccccgtgggactgtgtgctttgcccttccgggttctgcggaaggaactcg

SEQ ID NO: 90765 - DNA, 264 bp, Homo sapiens
tctttttggcatagtaccttttgctgtttctgaattcaaaatttaaataagtaaaaaatcaattatcactttatgttatgttctttttttctccaccgttgttttctttcctaatgtatcaagattagctgggtgtggtagtgtgtgcctctgtagtctcagctacttgggaggctgagtgctgtagtgcacaataattgcacttaggattaaccactgcactccagcctgggcgacataccaaaccctgtttctcttaaaaaa

SEQ ID NO: 90766 - DNA, 241 bp, Homo sapiens
ataggtaaggatttagctccatcatcgagacttcgacctttttgcaacttgacactttactatcttttgtgatgtaggtctcttaccatttttttttccctttctactccaattattccttctagtctctgttgttggtcctttttttaaaatattatttgtaattaaaggttctttttaagttgacattttcaaccaatgtgctctcgctttattttctttatattcattgtttttaaat

SEQ ID NO: 90767 - DNA, 344 bp, Homo sapiens
  misc_feature (81)..(81): n is a, c, g, or t
  misc_feature (93)..(93): n is a, c, g, or t
  misc_feature (95)..(95): n is a, c, g, or t
  misc_feature (100)..(100): n is a, c, g, or t
  misc_feature (104)..(105): n is a, c, g, or t
cgggtgactgtagacccagctatagggtgggaagatcctttgaacctgggaggcggaggttgcagtgagcggagatcacgnccactgcattcncnagccntcgnnggtgacagtgagactctgtctcaaaaaaataaataaattgcagctccgtgtattcaagacactgctggttgaaagaaaaaaaagcaatacattccagctccacctttttctaaccatgtagttttgggtaaattacttaatatgtagatcctcattgataacatgggaataatagtactcagtttgctgggttgtgaggattgaaaataatacttgtaaagtgacagagtctgatatgt

SEQ ID NO: 90768 - DNA, 135 bp, Homo sapiens
tgctgggattagaggcgtgagccacgatgccaggcctaactctgtctttttcatagactctgtaacaaacccattttgttattaagaggacaaactcacccactgtaatcccagctactcaggaggctgaggcag

SEQ ID NO: 90769 - DNA, 404 bp, Homo sapiens
tttgagttggacactggggctccaggtgactcataaagcgacatagtgcagttcttccgagaatgtgggacatggctagccattaagggcactctgatgcgtggcagctttggggaaataaatagcagtttgggaaactattctttgtttaggagagactttctcccacggataacgtgtaggatcttattttagactgactgttaagtctctgaagttgccccttttcatggttgtgtatctgactcagcatgggttgttcatctgactcagcatgggttgttccaggagaacgcgggaccaaatttaacagggcagaggatacaggcttgaagcactggctttgccaatagaagactttctaaggaatgactttgtctcattcaacatttaaattttcactc

SEQ ID NO: 90770 - DNA, 810 bp, Homo sapiens
atcagaattcctcatacctcccttgctggatgaactaaaatatttcccaaagtagcagcaaatatggctgtaaaaatgtccatgcaaaatgcagatgcccttcttgttgctgtgatcttctgaaagaaatgggatcacggcctcctctgggctctgtttgttagccctggaggggagggggcaaacaccacagacatcttgctagcttctcccaagagccaggaacatgtcagctctcagcaactcaactcttccttttcagatacatctggtctcagggccaggcatcacacgaataaaaataaagtacagtagagtaaaattttggctaataatgactgttccctactcagagttggtagggtgaggatacaaaaagccatagaaaagtattgatactctataataaattacaaacatatcatttaatgttatttttaaaaatggagaatgaaagcagtgaacttagcttaacagtgaaattaatgtgcttatcttgacttttggaaggaaaatttgaaaggaatggttaagctgccacccagtataaaatggtcagccataagaggggctgaatgtagacccagacagaccacctagccttctttcccatatcaccccctttttagtggtgaaaacaaaacaccaggctaccaagaaactgcccttcctgtttaatgtgcttgtgactttatgatccaagagtcacatatccaggaagaggtacccaaaaatctagtgctgcagacactgtttagcagaataaactccatgtttccaaaataaagcagcatcttaagtcagcctaag

SEQ ID NO: 90771 - DNA, 868 bp, Homo sapiens
tgatggtattgagaaaatttctggcaaggattttgctggagggtaggagagtaagtggtatttatcaagaaagtagtcctaggagagagaggcactcagctgtgtcccagagtggagtcatgttgtaatgaaaaggagtcgcatagccaggcaggttgtgcacgcctgtgatcccagctactagggagactgaggcaggcagatctcttaagcctatgagtttgagactgcagtgagctatgattgcaccactgcactctccagcgtgggtgacagagacccggactctaaaaaaaataagaagaaaaagaaaaggagtcgcttcctttgtattgagttataggtataagggtgggaatgtctgagatttccatcaaacagtagaatgctgatttttcattttgctggtataggcgtagacatatcagtgaatcaggataagaacattgcatatcctaggtaacaatgggttatttgatgaatggaatttggacaagtgtctggcattttagaaacaaataataaaacaaagtagaatttcttctttactctttacacaaggctaaattcaggtagttcaaagatttacatgaaaatatgattatcctagaagaaaacatgggtaaagccttttttattatcctgaattgaggaagcccttctaggcatattcaaatctcataaaaggaaaaggttaataaatctgatgacataaaaatagaacatttctgttttgaaaaaatactttaaagtgaagacaaatgataaacttatatttgcaattcatatgtagacaaaaacggcttgtttccttactatgcaaagaactctgatgtggttgttttgtggatgatttgcaccctgtgat

SEQ ID NO: 90772 - DNA, 734 bp, Homo sapiens
cttattgtcaccagttgtttataagaatgcccctttctccatacttggaaaactgaatggcattagcctgtagcctttttcagtcggaagcttgaaaaactggatctgttcttgaagttacttttgattagaagcaggtttaagtgccttttcatattactgactgacttaccgaatgcagcttttaatgtgatcaactattacctcgcttaattttatgtcctttgtccatctgtatcagttaaggttagtttcggctgcatataacaaagacaaaaaccaatgtgttacaatcgatagaattgcctttctctgtcttgcctagttcagaagtaggcagccagggctgggatgccattccatggtgtctttaagaaactaggttcccatctttctgttgtacctgcctggcttttcttgcaaaatgtgtgtgcctcccagctaagccatctccttttgacagccttaccagacgtctatccaatattcctgtctaattccattggctggaatgtggtcatatggccaccccttttgcaagcaagactgaaatgtagtcttgactgggatgcattgctgtcctgataaaatcaaagttctgttgttaagaagaagtgagaatggacattgaggtagataactagctgtgtcccaggtggacatccaaattttttcagtgtgcaattatgtgtataaactaatttgccttaaactttactttttctattacttgg

SEQ ID NO: 90773 - DNA, 305 bp, Homo sapiens
ttctctaggattatctgtacttcccctctgtcctcttttactacgggagatcgagctagctataacccaccttctttcatgagaaccacactaaattgcaaaaattatcccagtgctggaggagggcagcaggttgagattatgttggcaggaagaatgttggcattgattggcacgcaggggacgagagctgctttgtgctttaaaggtaactgagtatgagctaaaaagaaggaaaggagaggccgagagtaggaagaagaaagaaagctgacttggctggaggggtggagtgaagctgagga

SEQ ID NO: 90774 - DNA, 339 bp, Homo sapiens
tagagggtcctcagcctgctactcagctagctgcccagcacccctccccgtgtgatgtcccattggtctgctggcttctgtctagcacctttgctttccacactccaccctgtgcactcagcagtccttgttgcccctctaggacattacccagagcagatgcattggccccagctaatgggctcccttataaggggcttccacttctgactcctgcatggaccttgggcaagtcacttaacttttctgagactcttattcttttcccacgagatagagaggagaatagtacctattgaacaggaccaaacaggcacatggaaggggtttgaaagcaag

SEQ ID NO: 90775 - DNA, 448 bp, Homo sapiens
gcaccttgactatcttggatgacactcagtatccggtaattgaaggactggagacatttgtggttttcctcagctcagcacaaggagccgaactgaccaaacccttccaggcagtcattgcaattaatgacacattccaagatgtgcccagcatgcagtttgccaaggatttgctcctagtgaaggagaaggagggtgtcctgcatgtccctatcactcggagcggagacctgagctatgagtcatcagtgaggtgctatactcagagccattccgctcaggtcatggaggactttgaggagagacaaaatgcagactcttcacggattacatttctcaaaggggacaaagtgaagaactgtacggtctatatccacgatgactccatgtttgagccagaggaacagttcagggtctacctcggccttcctcttggaaaccactggag

SEQ ID NO: 90776 - DNA, 1116 bp, Homo sapiens
gtcattatttgacctgaccaatggttaactggaaggcttaacttgcaatgctatatttgtttcatctgagttagagcttgcccaatgagataagctttttcccagaacttcacacttactcaaaaaagacattgaaaacgctattttaaatatgttcaaagaaccaaagtaaacaacgtctcaccaaatagagaaaatcaataatgagatagaaattacgaagaaaagccaaaaaggaatgaacagattctcagagacctgtgggacactgtcagatgtaccaacataggcatgatgaaagtctcatgtcaaccataattttcacccatagccatacatgcccaagagaattgaaaacatgtaatacttgaatgtgaatgttcatagtggcataatagctaaaaaaaaagaacccagatatccatcatctgatgatgagtgaacagtgtggtttatgcatacagtggactggattcaggcataaaaaggaatgaagtattgatacagactacaacgtgaatggatgagccttaagaatatcatgctaacaaagaagctaaacacacaatatggttccacttacatgcaatgtccaaaataagtaaatccatagagactgaaaatacatcagtgattgctaggagctgggagagggaagaatagtgagtgcatgctaatgagtctgacatttacttttagaaagatgaatgtattctggaattggatagcgctgattatacgaccttgtgaatatacaggatccactgaactgcactttaaaagggtgaatattgtgtgaatcatatctcaatttaaaaagatatatataaagttccctgggtgaatactggtttccctcctcccttcagtatatgtgaaatgtagtgaaatttatatggttctgacagtattttattttaatgatttttcctccatccttggtagttttttttttttcctttatgtatatgaaacggcaacactgttcgtgaagtcagagctacacaaaatactataatcggaggagtggcaactctcccctttcccattgtttgttctttccaccccattcccgcccgccccctgtaaacaataaatctcattaatccctggtaa

SEQ ID NO: 90777 - DNA, 687 bp, Homo sapiens
tctgatatacagagttgtaacatgttatttaaaatgtccaattttcaccaaaaaattatgagacatgcacaaaaacaagcaagaatggtccatgcactgatggggaaaaaagcaatagaaattccctgaggaagcccagacttcacacttactcaaaaaagacattgaaaacgctattttaaatatgttcaaagaaccaaagtaaacaacgtctcaccaaatagagaaaatcaataatgagatagaaattacgaagaaaagccaaaaaggaatgaacagattctcagagacctgtgggacactgtcagatgtaccaacataggcatgatgaaagtctcatgtcaaccataattttcacccatagccatacatgcccaagagaattgaaaacatgtaatacttgaatgtgaatgttcatagtggcataatagctaaaaaaaaagaacccagatatccatcatctgatgatgagtgaacagtgtggtttatgcatacagtggactggattcaggcataaaaaggaatgaagtattgatacagactacaacgtgaatggatgagccttaagaatatcatgctaacaaagaagctaaacacacaatatggttccacttacatgcaatgtccaaaataagtaaatccatagagactgaaaatacatcagtgattgctaggagctgggagagg

SEQ ID NO: 90778 - DNA, 439 bp, Homo sapiens
caactgtcagtccattaggattatttgaggtaggcgtctaattcatttttgttaaggtaactgaatctgaaatatttaatttgtgcagaatctgtagattcctacaaacaaatcagtccagtgctttccctgctttctgtgtctcttactagagatctcatttatagctcacctagaagacggtagagaatatatgacatatataatatcaatttggctgtaggagagactgtgagtggaatggataggaacataagtatgccagttggcataagtccttcatggcacagaaacatgaggaaaaattctaaactatgttgatagaggaagagattgagtccaccataaattaagactaggattttaacaaaaaaaatatttctgggctgtcagcaaagtcatttacatttttagtttttattagcagcataatttaaag

SEQ ID NO: 90779 - DNA, 977 bp, Homo sapiens
gacctgctgctgactatttgttggtagttttgtcttttacacatttgctgttagatttagttattttgaaatgttgaacttgaaatgtaatgaaaaggacacatcagaatttatcatcagggaagatatcttttatgttgagcagctgctatctgatcttgacagactgtcctcttagaggactgttgaagtccattctagtcattttgtaacttcataactgcagaaagaaatgatgcaaggactgtttagtggactgagatggctgagcaggttcttggcctgaattatccagaggagataggtggatctagcttcagaggaagtctacaccccattcccttctgcttacaatgtacccatgatatgtgtttagcacagtaatactgtaacaggacatcacatggaaaaatcaaagcagctggctcactgtatttaactgaaaagaatgcctacagattggatatttaatagggaaaattaaggcactttaataacaaacttcattatgtgaaacttgttgaatattaacatacaatataccttgtatattaatgccatagtttttagaaacactaattaaacaacaaatttaaggggtgctggcatatcccagtgacaccttcagttttattgctgcttagtattttctagtaaattagttttaattattggtagtctgttgggcaccatttgggaaagaaataaattggtctcagtgtagcagacttgtagccaaaaactttgaataaaaaataagtataataaagaatattatttcatttttaaaggaattgtattattttgaagtgctgtgtggttgatatggtttggttgtgtctctacccaaatctcttattgaattgtagttcccataatccccacatgggagggacccagtgggaggtgactgaatcatgggggcagttttccccatgctattctcatgatagtgattgagttctcacgagatttga

SEQ ID NO: 90780 - DNA, 406 bp, Homo sapiens
ccgttctgggatgtgtgtaattgtagtaggtcattacccagaattatatgccatgtgtgacagtctgcagagataggatgttgcaacactgtcaccacatggctcacagagtagaaagtcattcttcaatttttatgataccttaatttctattttaaaaagcctttaaaaatcagcatttggatttttatgttattacatcccagaaaaatgatcttctagtgaatataagtacagagtagtagtatcatctggattgtaatgtttcctttaggtgactgaaatgacctacccctttctcattgcttttgaaattgaaaacacttttgacattgtttttgggacacaggttctaaaaaaaggcaggtagatggatcacttgagtatatcaaggaatacctgcatc

SEQ ID NO: 90781 - DNA, 647 bp, Homo sapiens
ctgcgctgcactaccaacagcaaaagaagtgaatgggacagctctgaagtatttgaaagcaacagcaggatggctgtgagaacctgcctcacatgtagctgaccccttcctcacccctgccaacagtggtggcatatatcacaaatggcagtcaggtctctgcactggcggatccaactgtgatcgaaagttttccaaaaataagttgtgtctgtattgaacatgaacagactttcttcttgtcattattctctaacaatactgcataacaattatttgcatacatttgcattgcattaagtattctaagtaatctagagacgatttaaagtatacgggaggatgtgtgtaggttgtatgcaaatactacaccattttctatcagagacttgagcatctgtggattttggtatccaaggggctttctggaaccaatccctcaaggataccaagggatgaatgtaattgtacaggatatcgcattgttggaattttatacttctttgtggaataaacctatagcacttaatagatagtacagactcattccattgtgcctgggttaaagagcccaatgtatgctggatttagtaagatttgggccctcccaaccctcacgaccttctgtgaccccttagaggatgact

SEQ ID NO: 90782 - DNA, 255 bp, Homo sapiens
ggagttctccggagaaaccgcttccggcgctcctgacacactgagatagaaagtttcacagaaatagggcaagggatagggcgagggctccagggcaggcgtcctagggcacctggcgcaggggcggaccggaaaccccaggcaaacgcagagtcggagatggcattccaggcggaagatcaagcaaaggcagagagggaggacggcaccgagcggctccctctgaccaggactgaggatgatgcgacctgatac

SEQ ID NO: 90783 - DNA, 448 bp, Homo sapiens
gtagacggtcgtgactgcaattgtccaggttcttgacattttgaacaaagaattgaacaaaaggcccagcaaagcaaagaaagaatgaagcaacgaaagaacgaaagcagggatttattgaaaacgaaagtacactccacagtgtaggagctaccagggcagaggctcaaggacctggatacagaatctgcctgggttcaaataccctctagaggtttgtttccctttggccacttcatgctcacctcatgtaaatgaagtggtagcccgcaatcagtctgattggttgtagacaaccattcagaggctggagtgaaattacaaagttgcaaaggaagactggacccgcaatcggtctgatttgttgctaactcccaattttccaactgcctggcagaaaatgtcaaggggagtagcctctgatcctcttgttacttcggggtggaaa

SEQ ID NO: 90784 - DNA, 658 bp, Homo sapiens
ctagaaataccatttgacccagcaatcccattactgggtatatataaaacggagtaaactttcatttaaggaaggatgaagttaaataagcaaaggtacccagagaccccactaagtgatagatactagctgaatgctttatttaacaagcctactattctattgctaacctgcttgagtatgatgcattgctactatttctaaactaccaatttatttcccctgtgttttgaggactcaatctcaaagatgctgactgaaaaataaagtttttgaacaatttcatgaaggttgggttgtcgagatcatgagttctgtctctaatgacaactctgtgggaaatggataaactctgataaactctatcgcactgcacacaaatgtgaggctggaaggcagtacgtaatttatgaggccttttgttgtaaaaatgagagttggcaggattccgagtaaatatcttttttcctaagggtggaagataggacttggagagatcaatgtgttggttgacagcatttgagaatgtttgatttgagcttcagcatcataggtggggaacatgtggctttatagatctgctgtttcttcccctgcccagtggtgcattccttgtctttactgaagtatgtttttaaaattcatttttaatggtggt

SEQ ID NO: 90785 - DNA, 433 bp, Homo sapiens
gcatttttcccccgtttggttaccccaaatattgtggacttctgcttgtttatttttctactactttgatatagattgaatcagccaaatgatggagaaggaacaaagcaggagaagaggttaaaacattgttaagaaaaatattctaataaaatcccactccaattttttatagtactctttttaggcatcaaaattaatgtctactccattgtttcacttctctctaaactatgtccaaataatagaattaagtgaattgattgaggtgttattagaccctttcttgcttagtcttagattagtacatgcctagatattttatagtgagacaatatatttgatttcaaatatcagtgtatttaattttttaaaaattaattacttctttacatcagttggatattctgaattatcatgagtatatccctga

SEQ ID NO: 90786 - DNA, 506 bp, Homo sapiens
ctgagggatgtttcactctgacagttcattgagctgaatatttatgatggcttgtggccttttccatatagatgttatatttcagtaaaaaaagttaacagaaatataatttttaaaaagtattacattaagtgatgttttgaagtcatgaatatactcaggcagggtgcatgcaaaaaaccaactgttctagtgtgatgcaaaggaaacttgtgacttaggataaagtttccaaggactgcatcatctgtgaattcaaactgtgctgtgtcctctcccaagcccttcgcttaaactgaagagaaggacatctgttctgggaaaacatgtaagatggctgaaaaagtgatcctaatgatgagaaagacactgcttgtgttgagtatgcataaaattgcttcataatttatgagaatggaaaagacaatatttatcagttatatatttttatatgatatatgaatttaaatatatgtccaataaagtccattaactcatagaagtac

SEQ ID NO: 90787 - DNA, 388 bp, Homo sapiens
ccataagatcatacaaatatcctgaaacactcatctatctcaaaacacccatcgtttagaaatagaaatgaaacttaaggtgatacacccatctatctgatcacatttaaagatgagaaagatgcattgtaacaccacaatttcctaccagtgcccattacaaagaacaggttaactgcaggtggactgaccaagcagttcctctggatctgtggtctaaatgaaaccaaatgggtacttcaagactgctcaggaatgcaggaggaaaacaaagccagaggactagcaactggctggctaccaccataggcatagacaccagaggttgtgcaatgtcaaaggcatatttcaaaatatcaaagtacctctctcagggaaataaaagatg

SEQ ID NO: 90788 - DNA, 159 bp, Homo sapiens
agattatgacacatgtttattgggcgcctgttatggaccagccctgtgctaggacctggggtgcagcggttaataaggtacacattgctgctgccctgagagttggcttggtggtgaagagagcccttggctggtggttagaaagccagcttttggatc

SEQ ID NO: 90789 - DNA, 384 bp, Homo sapiens
tgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacatt

SEQ ID NO: 90790 - DNA, 208 bp, Homo sapiens
tatattaaaagtagatgttgtaaacggacatattttccaaatatctttttgttaaaatccacatgaaacattgtctttgggcaatggaatggccaaaccacctttttggacaggacacgttgtatttgtgttctggtctagggaagagcagaaaggagcaaatgcccatgggctccctgtggtgaggccggattaaccagtgtctcac

SEQ ID NO: 90791 - DNA, 385 bp, Homo sapiens
tcatctgtgatggggaaagattgtagcatccaaccaaagagctataaagaagacagtgttgtacagtttatgtcttggtcttaattctaaacttcccttccaatatgtgcttatggatgttttaactcatttttcgtttgtttgtttccactttgtcatctgttcccattctttaatattactttcatttccagctaaattgttaaactccagttacatggagaatattaccatgggaaaacatcatttaatttatattctatctagttctggcaatagcagtaatacataatgtaacttctcagtgattctcatgtcataatttaactagctttgacttttactgggagtaagcaccctactctggaaaatccatttcataatt

SEQ ID NO: 90792 - DNA, 534 bp, Homo sapiens
taattggcatgtaatagacatttgatcaatagttggtatatgaaggaatagagtcctcagatgtataactcccctgaaagtgaacacaaaattgcatgtaggtgcacaatgcatttttctgagcagagagggctttttatttatttatttgtttttaaattgtaagaggaatttatgatgaaaaaagtccaagaaccctgcactagtctatgctgccctagggctatctggaataattaattttcaaatattgaggcacttaagagacaaagaactaccttgtttccttggacagtagaatgaaatgggtagaaacaaggaaggctttcttgatgaagatgtttgctgaataaaaatacttcacattttatgtgaattgataatcatttgcatttgcctgttccaaatgcacaagttacaaagtgaaagctagttttcttcactccagctcttctcagtgtggccttagtcctttgtaaatgtggtttctctctccagtactgctgagctattagagttttctaccgcatctta

SEQ ID NO: 90793 - DNA, 385 bp, Homo sapiens
ggagagaacaaaccctcttactggccttgggcccatccctctttctcccacactgctacttttgagttatctcattttgctcccaatagtcagccttgacttttctgggcttacctgggcatcagggacccatgttgcacattcagttgtcccgattatgtctgccttagagcgtctcctagggcagccagtctggaacagtcagtcacctagggtcctggagctcctgcagtctgccactcgctccttctgcctgataacaaatactattccttttatccttgcaactcgacccagaaagaggtggctgtcaatgtccaaggcccctggaaacgaagactggaaatgtgaaaccactgggcacaggggaatgggtgggtctgag

SEQ ID NO: 90794 - DNA, 764 bp, Homo sapiens
tgctgcagggggtgcatggaagaaaactggcctgctttcgaggacatcatcagagcccagagttcaacagatcatgaacacttcgagacaaatgaagacaggtgcaatctccttgaagaaataaaatctaagtaccaacatcccttctgagtcaagaatctcctctcttaaaaatgtaaagctattgatcagggagggaagtgtattaagcagagcatttttgatcaatggctgtatacttcctcctccctaactcccaaactccagacacaactgcagtaactcctgagattcttatggagcaggagagcagataaatggaggagatgaagcatgaggactgaatatggaaatttgggtgctatatgtttaatattgactgatataaatcaacatgcatatatcaatgtgtcacactttccagtttctaggcaaagatctttggtgctgatcactccaccctctgtataccagataattgtggccccctctctctctaagcaaagatggtagggattgtgaggtgagggtgggcttggtagaatgattgcagaattttaaaatatatatatctctctctctatttgtttccataatgtaatcattactctacatgctgttttggaactttttcacttaatataacatgacactttctacttgatatactatagatcataaaataattcattctctctatatttttgatgacttactgagttgctttgctgagcattcaggacacaataatgaaaaaatgagta

SEQ ID NO: 90795 - DNA, 1703 bp, Homo sapiens
gtgagggtgtgactgagtgcatgagagtgtgactgcctgtgagtgaatgtgtgactgcatgtgcgagtgactgcctgggaggatgtgattgtgcatgagtgtgcatgtgggtgtgactgcatgtgagggtgtgactgttgtgcgtgtgaaggcttgattgtgagtgtgcctgggaggatgtgagtgtgagggtgtgactccctgtgacatgagtgtgcatgcatgtgagtgtgaggaggagtgtgtaggtgtgagtgtctaggcaggtgtgtctgcagtgtgtgcagcatgtgcgtaagtgcatgtgaatgtgcgtgtgttgcatgtgagcatgtgcacgcctgtgcgcgtgagcattgtgtgcgtgatgggagccgtgggtgctgtgtggacagcccctctgcccctcccatgggctcccacgcccagcatccacctgagagaggagggagctgccttcccattctgcagagtctgtgtgctgaggccccgcagaagcaagtggaggagctgggatgtgaacctgggaccccggcgtagggggctgcttggctgtggaccctgcccctcaggaaagcccagggtccacctccagaggactcgttctggggcgggggcggaggcggggggcctccccacccggggctcgatgaggggctgtccgtttcttggctcgagtgctgccaagtgctccctgctgctgcgcccaccttcccggggagaggcgagcccctggctccctgagttcatgacccaccctgtccaccatcagcagctggcttgtgtctctgggtggctgggcaccagcctcctggaggccacgtgcctgggtccacatggagggtcctggtgggggcatcatcctgggtcccgggagtgaggctggcaggtgcccatcgggggtgtcaagtccagggggatcgaggctctggaagctcaagggggctctggccttggggaccagctgagtttccagctggcagccaggtcctcgagggaaggggtttggacagaatccgaggccccctaagctgatggggtcccctgtctccccttccagccctgacccactggacatggggactctttccagtccggagagctccttgtctgtgtccccagcagaaggtggggtggctcctgcctcaccctctgcccagccctgatccaggccacagccatctagggccctgaaggaggggcaggaggcaggggtggcttctggaacctgaggcttggccccggttgggtctgttcttgggggctgcactgctggatcccaggagcaggtgtggaacagccccatggccagggtgatggaaatcctcggctgcatgcagacatagacccaccctggactgggctgtctccggagcctagacacatcgccctgggaaggggcagctgggcctgcagtgtgctgggcaggggctggcggccctggtcgtgggctctccagggtccctcaggggattgggcctctccccaggcaggaaggtgggaagtgcaggcatgacccggggttcctgaggctggtccaccaagttgcttctgagacgccttcgcttctgtcctggctggctgttaatgatatccctgttctaattccactctggctaaactgaaagtaaagatccttaagcttacatgtgtctattcctcaaaatcaaaataaaaacaaaagcacccgagtctccaacagg

SEQ ID NO: 90796 - DNA, 1645 bp, Homo sapiens
gtgagggtgtgactgagtgcatgagagtgtgactgcctgtgagtgaatgtgtgactgcatgtgcgagtgactgcctgggaggatgtgattgtgcatgagtgtgcatgtgggtgtgactgcatgtgagggtgtgactgttgtgcgtgtgaaggcttgattgtgagtgtgcctgggaggatgtgagtgtgagggtgtgactccctgtgacatgagtgtgcatgcatgtgagtgtgaggaggagtgtgtaggtgtgagtgtctaggcaggtgtgtctgcagtgtgtgcagcatgtgcgtaagtgcatgtgaatgtgcgtgtgttgcatgtgagcatgtgcacgcctgtgcgcgtgagcattgtgtgcgtgatgggagccgtgggtgctgtgtggacagcccctctgcccctcccatgggctcccacgcccagcatccacctgagagaggagggagctgccttcccattctgcagagtctgtgtgctgaggccccgcagaagcaagtggaggagctgggatgtgaacctgggaccccggcgtagggggctgcttggctgtggaccctgcccctcaggaaagcccagggtccacctccagaggactcgttctggggcgggggcggaggcggggggcctccccacccggggctcgatgaggggctgtccgtttcttggctcgagtgctgccaagtgctccctgctgctgcgcccaccttcccggggagaggcgagcccctggctccctgagttcatgacccaccctgtccaccatcagcagctggcttgtgtctctgggtggctgggcaccagcctcctggaggccacgtgcctgggtccacatggagggtcctggtgggggcatcatcctgggtcccgggagtgaggctggcaggtgcccatcgggggtgtcaagtccagggggatcgaggctctggaagctcaagggggctctggccttggggaccagctgagtttccagctggcagccaggtcctcgagggaaggggtttggacagaatccgaggccccctaagctgatggggtcccctgtctccccttccagccctgacccactggacatggggactctttccagtccggagagctccttgtctgtgtccccagcagaaggtggggtggctcctgcctcaccctctgcccagccctgatccaggccacagccatctagggccctgaaggaggggcaggaggcaggggtggcttctggaacctgaggcttggccccggttgggtctgttcttgggggctgcactgctggatcccaggagcaggtgtggaacagccccatggccagggtgatggaaatcctcggctgcatgcagacatagacccaccctggactgggctgtctccggagcctagacacatcgccctgggaaggggcagctgggcctgcagtgtgctgggcaggggctggcggccctggtcgtgggctctccagggtccctcaggggattgggcctctccccaggcaggaaggtgggaagtgcaggcatgacccggggttcctgaggctggtccaccaagttgcttctgagacgccttcgcttctgtcctggctggctgttaatgatatccctgttctaattccactctggctaaactgaaagtaaagatccttaagctt

SEQ ID NO: 90797 - DNA, 254 bp, Homo sapiens
  misc_feature (17)..(17): n is a, c, g, or t
gagagagagagagaganagagagagaggagagagagagagagagagagagaggtcgtgggctctccagggtccctcaggggattgggcctctccccaggcaggaaggtgggaagtgcaggcatgacccggggttcctgaggctggtccaccaagttgcttctgagacgccttcgcttctgtcctggctggctgttaatgatatccctgttctaattccactctggctaaactgaaagtaaagatccttaagctt

SEQ ID NO: 90798 - DNA, 311 bp, Homo sapiens
ggtaggaggatcgcttgagctcaggaggtcaaggctgcaggaagctatgattgcaccactgcactccagcctgggcaacagagcatgactctgtctccaaaacaaaagaataagataatgataacctttacaggttccagagattgggacctgataaatttgaagtcattattcagcctctggcagagggtgagagaggcacatcagagttccttcaggacatctctaatggcacacatttatggataccttcatgcttgacaaaagtagtgaccagtctctgggggcagacacatttttgaggattctgt

SEQ ID NO: 90799 - DNA, 289 bp, Homo sapiens
  misc_feature (7)..(7): n is a, c, g, or t
  misc_feature (215)..(215): n is a, c, g, or t
gagcttngcctgttctttgcctatgtactcctttgtgtgtggcttcttttgcttctctttgtggagagattttttaataatagatttgtttccttgaatagatagagaactattgagattatttacttcttcttaaattagttttggtctgtcatgtttttcataagggatttgttcctttctattaaaatgatagttttttgacttacagatgngtttataccctcgagttataattcaacgcctgtaagatctttacattctcttttcatttgattttgataatttg

SEQ ID NO: 90800 - DNA, 187 bp, Homo sapiens
acctgccttggcctcccaaagtgctgggatcacccacccatgccagtgtcttaaaacatcaaatcatcaccctcaaggtgtcagtggacaattcctgtataattatgtaaagatccgggaaagtgtttaggaaaggataaaattgttttaccactctaaatgcatgctaaatgcttgggctgaaaaa

SEQ ID NO: 90801 - DNA, 1006 bp, Homo sapiens
tggcataataggcacacccaaaaatgtgtgaggtgaaccatgggaatttatatattaatgtaatagagaagtaccaagttgagggtatagaattttattttatgttatttttttcgagacaaggtctggcccaggttggagtgcagtggtgcgatcttggctcactgcaactgttgcctcttgggctcaagccatccttccgtctcagcctcccaagtagatgggactacaggtgtacaccaccacgcccagctaatttttgatattttgtaaagacgggtttcaccatgttgcccaggctggtctcgaatttgtgagctcaagtgatctgcctgcctcggcctcccaaagtgctgggattacaagcgtgagccaccacgtccagctagggttttttttttttttttgtaaggttagtaaactttttcagtaaatccaccaccacccctcccagctttttattaggtaaactttcaaacatatagaaaaatggaaagtacatttgtcatttgtatacccactatatagattcagtagttgttgttttatttatctgtctgtatatgtggatgtgtgggtgtggatacacatatacacacatacacatatttaattgctgaaccattttaaattgcagacatactttgcccctcagtacttaacatatttaaattacagacattatgatactttgcctctcagtacttaacatatttatctcctaaaaaatgagaatattctgccatataaccaccatattatttacgtttgagaacatttccaaggccgagtgtagtagctaatgcctgtaatcccagcactttgggaggctgaggtgggcggaacacttgagctcatgagttgaagatcagcctgggtaacatagcaaaaccttgtctctacaaaaaatataaaaattagcgtggtgtggtggtgtgtgcctatagtcccagctacttggggggccgaggcaggaggatcgcaccagcctaggaagtcaaggctg

SEQ ID NO: 90802 - DNA, 532 bp, Homo sapiens
cagaagttgatattctgtctattggatcctgcttctcccctggggtcttcttggttccctgaagcccctcttccggagtccctgccctctatcggctctgcctcctgcttcttttctgtattgccatgatttttgctaaggataaaggacaacttcattggcttctttgggaaacttgcaatctccccaaacaggcccctctgagatttctcctttccatttgcttctgctcccccttcctccttttgccaccttcgatattttctccagtttccttgattcctttgatacgtccccattcaggccactctggccttccatccaacctgccagaactttttccacttcagcacttcagtcacttaaacattagggctccctgccctaaagggactcaaaatcctgcaaaaacaaccacctaaggataaaaagagaaaaaatgaaactgtttggaaactgggcaaatgaatactcttttaaaagtctttttctgggggccaggtgtggtggctcacgcctgtaatcccagcac

SEQ ID NO: 90803 - DNA, 502 bp, Homo sapiens
cagaagttgatattctgtctattggatcctgcttctcccctggggtcttcttggttccctgaagcccctcttccggagtccctgccctctatcggctctgcctcctgcttcttttctgtattgccatgatttttgctaaggataaaggacaacttcattggcttctttgggaaacttgcaatctccccaaacaggcccctctgagatttctccttttgccaccttcgatattttctccagtttccttgattcctttgatacgtccccattcaggccactctggccttccatccaacctgccagaactttttccacttcagcacttcagtcacttaaacattagggctccctgccctaaagggactcaaaatcctgcaaaaacaaccacctaaggataaaaagagaaaaaatgaaactgtttggaaactgggcaaatgaatactcttttaaaagtctttttctgggggccaggtgtggtggctcacgcctgtaatcccagcac

SEQ ID NO: 90804 - DNA, 479 bp, Homo sapiens
gattacaggtgcccgccaccatgccaggctaatttttttatttttagtagagatggggtttcaccatgttggcctggctggtctcaaactcctgaccttgtgatctgcccgtctcagcctcgcaaagtactgggattacaggcatgagccactacgtccagcctggatattgtttttattagcatcaatttatgtgattatatatgtcttccttagtttgttaatatggtagattatattgattaattttgaaatgttgaaccagccttgcatacctggataaatcatattggtcatgatgtataatttttcaatacattgttggattcaatttggcaccattttcttgagcatttttatacctatgttcatgggcaatattggtctgtagttttcctttcttgcagtgtctttatctggttttgatattaggataatgctggtcttatagtataagttagaagtgttccctctgctgc

SEQ ID NO: 90805 - DNA, 422 bp, Homo sapiens
agaaatagccacaaaaacagagtgatttggtctttgattttaaacttttaaaatccacgttttagaatttctgactcttccacttgcaagctagatgatgtcggcaagatacttaagttttctttgccttggttttctcctctgtaaaatgagaatactgcgttccatagactctaagccattattaagtcttattaattgtaagactcaccattaattcacataacgctaaggaaaaaatgcccattacaatggtgtcttaaattgagaaatgctaaaatataaaataatgtgcatcttagaatcgatgaaatttgctaatacttgccttagaagtttgtcatagggattaaatgggaagcatctagaatagcatctagcacacagtaagtgctcaataaatgactattcttgcagtaaag

SEQ ID NO: 90806 - DNA, 344 bp, Homo sapiens
gctttgcctgtatctcttcagtgatgagtaaatcccatgaggaatgatttagaatgccactgtacaaatggcagggttctgggaggacttagttcagccctgtgttccttagcagaactttgagtagatttggtaagaaggtgaagagctttcctgtatatttcagcagaagttgtgttgaatcacagtttgctacaaggttttgtgatggtggacattgtgacccttccaaggtctcttattcatcattgtttctattctcctgaggcaggcaaagaagcctgaaatgtagaaattgccttagatatgactctgttcattcttaatactgcaagtgctcttat

SEQ ID NO: 90807 - DNA, 501 bp, Homo sapiens
gattaatacacactggcaatttaaaagtaatccctcactaaccctggggaatccacactgatttataattttaaataattaaaaccccacatttatattttactacaaatacatccagctacttcagtgtgcttatggtacattcttttagccacttgcagttacattgggagaaggaatattttaccccaagattctccatgaaaatgttggatctggaacctctgatgccaccaaattcaagcaactgtaaaaatgttttctttttaaaaaaatgattctaataattcatttcctagtatacactggtcatgtaatttactgaaagaacataagctgttacagacattcagatgaagtcaggttagtagtggaacacaagataatgggaaacctgaaagaacaaaaaagatcacagtcttgacaactgcggtgaaacacttataaccttacatatatgcaaaaaggggattatgaaagacaatgtctagggctgcaagg

SEQ ID NO: 90808 - DNA, 579 bp, Homo sapiens
aataattatctgtggttcggggctctgttctcttggcccacagctccatccttggagtcattcttcctttttcaggaagagcagcctgtgtttgtagatgagccatttcatcagccaatttcctgcctgtagaattttggggagtctgacaacctttcgttttgttctttctttctcccattcagtccaagctggcagtatttctcctggtatgacattctcaaaagtcatgtgggactcccatgtatgtctctaggatttgctccattagacaagggactcctctgcaaatctttcctggaaaatcccctctctgtcctggcttctgctgaaatgtctaaggggatccatgagccacatgtctaatctcctgaaagagccctccatacaaatgaatactttgcattttgcatctttctgaggtacaagaaaaaaggttgtccagccacacctttagttttctctccatagcatacttttctgacagtgaatctcctaattttagaatcttctgcaatctggataggctgaaaatcatccaaattgccaagtcctggttcccttttccttaacaattct

SEQ ID NO: 90809 - DNA, 302 bp, Homo sapiens
aagtaggccttaatacctaatcacttgcattcggtggctagatttgagtggataagaacacctaccaaagtacaacttccaatttttatttcagaaggaaaccatccttgagagatgagaaaataacttactttaagctttattcatttttgtatttggctgccataaaatatcttttactaagtagctttagggttttttttttaatctaatcctgattaaattaaaagaaaaacctgggtaagttaattgtaagctttcccataaaagagagaagcacaaaatgccatgggaatatatcc

SEQ ID NO: 90810 - DNA, 391 bp, Homo sapiens
aggaagaatggaaaaagactaaaagactgaagatgggtagctatagttttaggttttaaagagcataaagactaaaattttcctatctccaacttctaagcctaacaacaattgatcaaatgaaagacaatattattaaatatatactttgtaagcatttacaaaaaaaggaattagtatgaccaagtgaaattagcatgtgtttactgataaaaagttttaccagtctagcattattccccacccttgttttttggtttggtttaatttaattttttttaaatgtttgttaattgtaaaaaaaaattaagaaaacaaagaaaaaaattctaactacaccgttaacatattagtatgcgtatgtgtgttgttgttgttgctgagaccgcta

SEQ ID NO: 90811 - DNA, 201 bp, Homo sapiens
tgacataggatttgattacaatataacaaagtcttttcaagccccctaagaaagggttctatctaaaatatcttaaaatatgtctgttactttaggttatttctgcttgcattaagaaaacaaatattgtttctatgtgaaggaaaatatacaatttaaaaaattaagttaatttgttgcatagatagtttgtgttcatgg

SEQ ID NO: 90812 - DNA, 295 bp, Homo sapiens
tgggaggtaggtggaacctgcagtgagccgagatcgggccactatacacctgcctaggtgatacagaccctgtcttaataaaaagagtttgccctgtggccctcaaggattcacatagggtccactttcgttaacctttgatacctagacatttttggaagtgcttctttcttattcgtttattttttcatttgttagcattgttactgaccctccaattttaacaacattttcttgtttctattggatagttactaaataagaaaagcaaccctcagaattaaacccagtgctg

SEQ ID NO: 90813 - DNA, 421 bp, Homo sapiens
aatcaacgtgactgggagaaagacggtgccattcacaaaagtatggaaaacctagggagattggtagattgtaggtggagaagacttaatcatttttaaatattgcattatagaatgtatagctataaagagcatcatgataatgcccaatccctttgtttcatgtagaagaaaatccagtgggagtaagtaacttgcctgtaatcactcagtaagttagtgaaatagccagttctggaaatctgatgccctattttccctaaacagtgtttcattcataagatgggctgtcttatgatgagtttatagaagtagaataattgtgtggtgctgtgcagtgatcagttggaaatacagatgtggcacttttgtaaaagatcggggacaatgatttgggaggcatctaaatgaaaataacatt

SEQ ID NO: 90814 - DNA, 248 bp, Homo sapiens
aaacattgatttagtaagtttacataaccatactttaaaattttttattgaaaattaatcagattttaatggacacatgaaagttgcatatatttatcatgtgcaatgtaatgttttcaaatgtgtgtacactgcgatggctaaattgagctaatgaacgtatgcattgccacacatacttataatttttttgcgtggtgagaacactccaaatctactctcttagcaatttttaagaatatgataca

SEQ ID NO: 90815 - DNA, 203 bp, Homo sapiens
acgttttggtcaatgatggaccacgtatacaacaattgccccataagattgtaatagaattgaaaaattcccatcatctagtgatgttgtagccatattactcacgtttatggtgatgcttgtgtaaacaaactgtcctaaaaagtacagcacatataattatgtattgtacataataataataaatgattactttactggct

SEQ ID NO: 90816 - DNA, 626 bp, Homo sapiens
cttaatactgtttatttgtgctccttcctttgtcttttcatcaagcttgccaggtttgcctattttatttgactttgtaacagccagcagtaggttttagtgactccttctgtttctttgttttccgttttactgacatttgctctcaactttctactttcttctttctcatttttttagattattgttactttctctaacttcttaaattgggtatagttaaccctttaattttcagttttctttttttaatttaatctcaatatttaaaaattacatcaaccactttattacatcccataaactttgataggtaggtaatagttttattcattcttagctatcttctaatttccattatgaggatttttttggtttccaaatgtgtgaggttttttgttttagttattattttgatgttgatttctcatttaattgcattatggtgagaatataatctgtgtaatgtttatgatttggtatttgtgaatatttcatataggatctagtacacaattactttgtaaatactttaaatgtaatggaaaagaatgtatattctctaaatattaaatgcaaggtatatatgtccattcagaaataaacttgttattttttatattatt

SEQ ID NO: 90817 - DNA, 1262 bp, Homo sapiens
aagagttctaatcaccatttgaaaccagagagtgaataagattaacttttttagaactctgaaaaataaaggctttacagcaatctgaggaggttttactcaagaaaaagaaataaatctcataagaatatcacctttgacctcagctggtaatatgcctgtcaggtggctcaaatttttttgtcacactgcgcatgtttgtgaagtgatcacagaagtgctctgattattgatttgggggttttacaaataaattttagcaagtaggctaatacacaaatacagaatctgcaaatagtgaggcccaactatatattcagagaactaaaggaaacatgcttaaagaattaaaggaggccaggtgaggtgcctcacacctgtaatcccagcactttgggaggccgaggtgggaggagctcttgagaccagcctgagcaacatctacatgtgcaacatgtagagaccctgtgtctacaaaaaaatttttcaaattagctgggtgtggtagtgtgcacctgtagtcccagctattcatgagactgaggtgggaggatcacttgagcctgggaggtcaaggctgcagtgaactatgatcatgccactgcactcccacctggacaagagtgagcctgtctcaaaaaaaaaaaaaaaaaaaaactaaagtatgagaacaatgtctcagtaaatagagaatatcagtaaaaagacaaattataaaaaaccaaaatgaaattctgaagtcaaaaagtgcagcaactcaagttaattcactagagaaggtcagcatcaaatttgaattaccagaagaaagaatcagcaaacttgtccagtctgagaaatgatagagcccaaaatgcatgaaatagcagaatcaaagaggcaaatggacaattcaaacatgagagttggagactttaacacccactctgaataatgggtagaacaactaggcaacaaagaaatggaagacttaaacaatactgtaaaccaactggactgagcagacatctatagactactccacccaacagcagctaaatatacattcttctcaaatgcacatggtctattctccaggatagaccatgtgttagcaagtaaaacaaacctaaataaattttaaaggattgaaatacataaagtatgttctctaactacagtaaaataaaattagaaaccaatagcagaaggaaatttgggaaattcacaaataagtgaaatttaacctaccttcccaaataaccaatggattaaagaaaaaa

SEQ ID NO: 90818 - DNA, 468 bp, Homo sapiens
agaacaaaaaagtgttattagaatctataacagcataatttcttgactttaattcttcagtactgttctaacacaaagctagtttcacaaagtttggagatttttattacatgtgaagacagggtaagactttataacttcaggactgacaaggatttggggcaagacagagtactgggaaacaagcttaaagttgagagagctcattatagaaacaatgcattagttttgaagttgagaatagagacaatcctagataattctggcttaaaaccactttacctaaagtatacaaatattagtttcaactacttggttcattacctcaaatatccactttactcaactatgtaataatcacaaatgattgacctgtaaccaataggatttctggagaaggtaacttccattcctttgtggactccggctggaaaagtcccttgggttaataaagttagattccatact

SEQ ID NO: 90819 - DNA, 155 bp, Homo sapiens
taattagtggctaaatgactcatgagcagtgtggtaaggtgacgaagaaatcaaaagtctgagttagagactcaactctgctattggccttgagaagtcattttcccactgttggcctctgcatattgtggccacctatattacacctatctgag

SEQ ID NO: 90820 - DNA, 547 bp, Homo sapiens
ttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatgga

SEQ ID NO: 90821 - DNA, 255 bp, Homo sapiens
acatcaataatttttcagacaaacctgtcataaagtcatattgtcatgtttctttcattattaccatgaaatcttgcttcttttaatagatttttttcctctatatttatactctttctgcttagctgccacagtaaaatgattattgtttttgggtagttttgtagctttctcttttttctctcacatccactattttgttctcttccttacccctacctaccctctcccaatgtgtctaaatggctcagaggg

SEQ ID NO: 90822 - DNA, 435 bp, Homo sapiens
gacttttactaattatcaggtaaaatcttagaattctatatcaatagtaaattgactagtttttttaaagtggtattttcattttcaatttaaaaacagaaatgagtctttgggaattataccaactgtgaatttaagtgcatgattatcatttttctcgctcaactccacccttgactctgcccattaatatactgtccatctttcttgaagcccaagtgaaattctaagacatcatcttcagcctttccaaatgacattcaccactcagcaccccaaagcctgtttaactctaatgtagcattttgtacagcacacttaattgtgctctggcacacgccttctttcaacccagtaaggacctaagcatagcatctacctctaacccacatttgttcaaaaacacagccaatcttgtgtccatgcattcctctg

SEQ ID NO: 90823 - DNA, 3613 bp, Homo sapiens
  misc_feature (610)..(610): n is a, c, g, or t
  misc_feature (961)..(961): n is a, c, g, or t
  misc_feature (1901)..(1901): n is a, c, g, or t
  misc_feature (2355)..(2355): n is a, c, g, or t
attagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcntggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatgntcataaacatgaagaattgtaggtgatcatgacctctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccagntcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagnctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccgttgcttattagtaaaactagtgttaatacttggcaagagatgcagggaatctttctcatgactcacgccctatttagttattaatgctactaccctattttgagtaagtagtaggtccctaagtacattgtccagagttatacttttaaagatatttagccccatatacttcttgaatctaaagtcatacaccttgctcctcatttctgagtgggaaagacatttgagagtatgttgacaattgttctgaaggtttttgccaagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttctatatctctctttatt

SEQ ID NO: 90824 - DNA, 404 bp, Homo sapiens
  misc_feature (352)..(352): n is a, c, g, or t
ttttttagacggagtctcgctttgtcccccagggtggagtgcagtggcgtgatctcagctcactgcatcctccgcctcccaggttcaagtgattctcctgcctcagcctcctgagtagctgggactacaggtgtgtagcaccacgtgcagctaatttttgtatttttagtagagacagggtttcaccatgttggccaggatggtctcaatctcttgacctcgtgatctgcccgcctcggcctcccaaagtgaaaagcatatttaaggacttgttcagctcccagggatgatgcccctccaaaagttcaggactgttttcatcaaacactttcctggtgggttaaactcatcncccttccagggatggggggctatgaaaaaggaagctgaaatgccaattgcta

SEQ ID NO: 90825 - DNA, 392 bp, Homo sapiens
gtacttctaagaaaagttgtatttatagtctctttttgcatataaaggtagcagaaccttaggactttgtttaggcccatttcttcttcctgtcccatcccctaggcatctcattcagtgccttaatttcctgctgtcaataagccagcaattctatctttattccagaatgttaatcttagttacagattcatattcaactgtcttctcaaattgaaatctcatggatcataatgaaccagtgatttccactgctacctcaaaactaaagaaaaaaaaaaaaaattcggcacggggtttttttttatggggcttaaagtaaagagccatcctttgcaagtcatccatgttgttacttggcattttatcttggctcaaattgttgaggatgg

SEQ ID NO: 90826 - DNA, 3991 bp, Homo sapiens
gcgtccggcgggagcccgcggcgagcgtagcgcaagtccgctccctaggcatcgctgcgctggcagcgattcgctgtctcttgtgagtcaggggacaacgcttcggggcaactgtgagtgcgcgtgtgggggacctcgattctcttcagatctcgaggattcggtccggggacgtctcctgatcccctactaaagcgcctgctaactttgaaaaggagcactgtgtcctgcaaagtttgacacataaaggataggaaaagagaggagagaaaagcaactgagttgaaggagaaggagctgatgcgggcctcctgatcaattaagaggagagttaaaccgccgagatcccggcgggaccaaggaggtgcggggcaagaaggaacggaagcggtgcgatccacagggctgggttttcttgcaccttgggtcacgcctccttggcgagaaagcgcctcgcatttgattgcttccagttattgcagaacttcctgtcctggtggagaagcgggtctcgcttgggttccgctaatttctgtcctgaggcgtgagactgagttcatagggtcctgggtccccgaaccaggaagggttgagggaacacaatctgcaagcccccgcgacccaagtgaggggccccgtgttggggtcctccctccctttgcattcccacccctccgggctttgcgtcttcctggggaccccctcgccgggagatggccgcgttgatgcggagcaaggattcgtcctgctgcctgctcctactggccgcggtgctgatggtggagagctcacagatcggcagttcgcgggccaaactcaactccatcaagtcctctctgggcggggagacgcctggtcaggccgccaatcgatctgcgggcatgtaccaaggactggcattcggcggcagtaagaagggcaaaaacctggggcaggcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaaggtagggatatctgtagttctggggtttttttaaaataaagaaatagaagaaaaatatagataattaattccattggttttagaaaaaattacaaggaagtttctttaatcctagctagtcattaaacttgttatttaggtggcaaataatggaaacagaccataatagatttatgtgataagaggcagagccaattggtatcaaccaagacttttcattataaatggtaacaacatagaagatagtataagtaaaaatattttatgtgcttctgattgcaaaatagaattttttttttctgaagtgtcagggtaacatctattggtcatcatctctgcagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattgaggaacatcatcaattgcagactgtgaagttgtgtatttaatgcattatagcatggtggaaaataaggttcagatgcagaagaatggctaaaataagaaacgtgataagaatatagatgatcacaaaaagggagaaagaaaacatgaactgaatagattagaatgggtgacaaatgcagtgcagccagtgtttccattatgcaacttgtctatgtaaataatgtacacatttgtggaaaatgctattattaagagaacaagcacacagtggaaattactgatgagtagcatgtgactttccaagagtttaggttgtgctggaggagaggtttccttcagattgctgattgcttatacaaataacctacatgccagatttctattcaacgttagagtttaacaaaatactcctagaataacttgttatacaataggttctaaaaataaaattgctaaacaagaaatgaaaacatggagcattgttaatttacaacagaaaattaccttttgatttgtaacactacttctgctgttcaatcaagagtcttggtagataagaaaaaaatcagtcaatatttccaaataattgcaaaataatggccagttgtttaggaaggcctttaggaagacaaataaataacaaacaaacagccacaaatacttttttttcaaaattttagttttacctgtaattaataagaactgatacaagacaaaaacagttccttcagattctacggaatgacagtatatctctctttatcctatgtgattcctgctctgaatgcattatattttccaaagtatacccataaattgtgactagtaaaatacttacacagagcagaattttcacagatggcaaaaaaatttaaagatgtccaatatatgtgggaaaagagctaacagagagatcattatttcttaaagattggccataacctgtattttgatagaattagattggtaaatacatgtattcatacatactctgtggtaatagagacttgagctggatctgtactgcactggagtaagcaagaaaattgggaaaactttttcgtttgttcaggttttggcaacacatagatcatatgtctgaggcacaagttggctgttcatctttgaaaccaggggatgcacagtctaaatgaatatctgcatgggatttgctatcataatatttcctatgcagatgaattcagtgtgaggtcctgtgtccgtcctatcctcaaattatttattttatagtgctgagatcctcaaataatctcaatttcggaggtttcacaaaatggactcctgaagtagacagagtagtgaggtttcattgccctctataagcttctgactagccaatggcatcatccaattttcttcccaaacctctgcagcatctgctttattgccaaagggctagtttcggttttctgccagccattgcggttaaaaaatataagtaggataacttgtaaaacctgcatattgctaatctatagacaccacagtttctaaattctttgaaaccactttactactttttttaaacttaactcagttctaaatactttgtctggagcacaaaacaataaaaggttatcttatagtcgtgactttaaacttttgtagaccacaattcactttttagttttcttttacttaaatcccatctgcagtctcaaatttaagttctcccagtagagattgagtttgagcctgtatatctattaaaaatttcaacttcccacatatatttactaagatgattaagacttacattttctgcacaggtctgcaaaaacaaaaattataaactagtccatccaagaaccaaagtttgtataaacaggttgctataagcttggtgaaatgaaaatggaacatttcaatcaaacatttcctatataacaattattatatttacaatttggtttctgcaatatttttcttatgtccacccttttaaaaattattatttgaagtaatttatttacaggaaatgttaatgagatgtattttcttatagagatatttcttacagaaagctttgtagcagaatatatttgcagctattgactttgtaatttaggaaaaatgtataataagataaaatctattaaatttttctcctctaaaaaaaaaagtcaaa

SEQ ID NO: 90827 - DNA, 3651 bp, Homo sapiens
gcgtccggcgggagcccgcggcgagcgtagcgcaagtccgctccctaggcatcgctgcgctggcagcgattcgctgtctcttgtgagtcaggggacaacgcttcggggcaactgtgagtgcgcgtgtgggggacctcgattctcttcagatctcgaggattcggtccggggacgtctcctgatcccctactaaagcgcctgctaactttgaaaaggagcactgtgtcctgcaaagtttgacacataaaggataggaaaagagaggagagaaaagcaactgagttgaaggagaaggagctgatgcgggcctcctgatcaattaagaggagagttaaaccgccgagatcccggcgggaccaaggaggtgcggggcaagaaggaacggaagcggtgcgatccacagggctgggttttcttgcaccttgggtcacgcctccttggcgagaaagcgcctcgcatttgattgcttccagttattgcagaacttcctgtcctggtggagaagcgggtctcgcttgggttccgctaatttctgtcctgaggcgtgagactgagttcatagggtcctgggtccccgaaccaggaagggttgagggaacacaatctgcaagcccccgcgacccaagtgaggggccccgtgttggggtcctccctccctttgcattcccacccctccgggctttgcgtcttcctggggaccccctcgccgggagatggccgcgttgatgcggagcaaggattcgtcctgctgcctgctcctactggccgcggtgctgatggtggagagctcacagatcggcagttcgcgggccaaactcaactccatcaagtcctctctgggcggggagacgcctggtcaggccgccaatcgatctgcgggcatgtaccaaggactggcattcggcggcagtaagaagggcaaaaacctggggcaggcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattgaggaacatcatcaattgcagactgtgaagttgtgtatttaatgcattatagcatggtggaaaataaggttcagatgcagaagaatggctaaaataagaaacgtgataagaatatagatgatcacaaaaagggagaaagaaaacatgaactgaatagattagaatgggtgacaaatgcagtgcagccagtgtttccattatgcaacttgtctatgtaaataatgtacacatttgtggaaaatgctattattaagagaacaagcacacagtggaaattactgatgagtagcatgtgactttccaagagtttaggttgtgctggaggagaggtttccttcagattgctgattgcttatacaaataacctacatgccagatttctattcaacgttagagtttaacaaaatactcctagaataacttgttatacaataggttctaaaaataaaattgctaaacaagaaatgaaaacatggagcattgttaatttacaacagaaaattaccttttgatttgtaacactacttctgctgttcaatcaagagtcttggtagataagaaaaaaatcagtcaatatttccaaataattgcaaaataatggccagttgtttaggaaggcctttaggaagacaaataaataacaaacaaacagccacaaatacttttttttcaaaattttagttttacctgtaattaataagaactgatacaagacaaaaacagttccttcagattctacggaatgacagtatatctctctttatcctatgtgattcctgctctgaatgcattatattttccaaagtatacccataaattgtgactagtaaaatacttacacagagcagaattttcacagatggcaaaaaaatttaaagatgtccaatatatgtgggaaaagagctaacagagagatcattatttcttaaagattggccataacctgtattttgatagaattagattggtaaatacatgtattcatacatactctgtggtaatagagacttgagctggatctgtactgcactggagtaagcaagaaaattgggaaaactttttcgtttgttcaggttttggcaacacatagatcatatgtctgaggcacaagttggctgttcatctttgaaaccaggggatgcacagtctaaatgaatatctgcatgggatttgctatcataatatttcctatgcagatgaattcagtgtgaggtcctgtgtccgtcctatcctcaaattatttattttatagtgctgagatcctcaaataatctcaatttcggaggtttcacaaaatggactcctgaagtagacagagtagtgaggtttcattgccctctataagcttctgactagccaatggcatcatccaattttcttcccaaacctctgcagcatctgctttattgccaaagggctagtttcggttttctgccagccattgcggttaaaaaatataagtaggataacttgtaaaacctgcatattgctaatctatagacaccacagtttctaaattctttgaaaccactttactactttttttaaacttaactcagttctaaatactttgtctggagcacaaaacaataaaaggttatcttatagtcgtgactttaaacttttgtagaccacaattcactttttagttttcttttacttaaatcccatctgcagtctcaaatttaagttctcccagtagagattgagtttgagcctgtatatctattaaaaatttcaacttcccacatatatttactaagatgattaagacttacattttctgcacaggtctgcaaaaacaaaaattataaactagtccatccaagaaccaaagtttgtataaacaggttgctataagcttggtgaaatgaaaatggaacatttcaatcaaacatttcctatataacaattattatatttacaatttggtttctgcaatatttttcttatgtccacccttttaaaaattattatttgaagtaatttatttacaggaaatgttaatgagatgtattttcttatagagatatttcttacagaaagctttgtagcagaatatatttgcagctattgactttgtaatttaggaaaaatgtataataagataaaatctattaaatttttctcctctaaaaaaaaaagtcaaa

SEQ ID NO: 90828 - DNA, 254 bp, Homo sapiens
ggctgggagacaggacaggcagcttaaggatgtgggctgtagaaggaggtgcagggagggggagcaagcatgacactctgggctccagcctgggcaactgggtgggaggttatggaacatgggaggcgggtcatttctggggctggagcagggaaagaagagataatgctaggtttatgctcccattgcaggagaagccccctcccttgcagacttgggtcccacctaaccatccagccatctgtccagcatag

SEQ ID NO: 90829 - DNA, 401 bp, Homo sapiens
ggaacctgggcattaaaactaaaatggcagagtggatggtagactagaagtgttttggcaaagatactgtgggaggtgatccagagagagggaagccgaaggaagagtacgcacatagagaaaatgttcagtaaccctgttgggttggggatgtgtttcagaaatgcctcctggtgggagtaggtaaggatgcagttgataatccagaagctaggtgatgcacacaccagtgatttgaaaattgccaaagcatctcagacctttaaatcactctctttgcctataggcccagactggagtcctgggagctagagagaataatgtctacaggaaaacaaaacacatttaaaagtcgcttattgaaaccaagggaaaaggagaaattgaaatgtgtttcaatg

SEQ ID NO: 90830 - DNA, 354 bp, Homo sapiens
  misc_feature (270)..(270): n is a, c, g, or t
  misc_feature (296)..(296): n is a, c, g, or t
  misc_feature (329)..(329): n is a, c, g, or t
  misc_feature (333)..(333): n is a, c, g, or t
  misc_feature (337)..(337): n is a, c, g, or t
  misc_feature (345)..(345): n is a, c, g, or t
  misc_feature (350)..(350): n is a, c, g, or t
  misc_feature (353)..(353): n is a, c, g, or t
ggcgctccacggccctgctctgggctcgcctgagtgctgggctctgcagacgcagggatgggccaggcgagcccctcaccacggaggtagcaggtccagaggaagcagcagaggcttcctggaggaggatttgtacccctaggaggactatgtcttcctcatctttgtcttcagaggataaatacaaggcctgacacataacaagcatgagcacggagtctccctctgtttcccagtctggagtgcagtggtgtgacctcgtctcactgncagcctccaccccccaggttcaagcnattctcctgcttcagcctcccaagtagctgggnctanaggnacctcctnatttnttna

SEQ ID NO: 90831 - DNA, 545 bp, Homo sapiens
tctgttaacaattcatatcttagatatgagacagggagatatagtaacttgaccttgacagtctgagcccttaactgctacaaacagctgctcctgacagaagagaaggctaagaacaaattcaagggaggtggtcagtgaagacctttttaagagaaaagatgacaaagggcactatatcctcagcgatttgccctgtgacttctaaactccagcagtagttgttgacttcacaagcctttgctgctgaagactctcgccccttcagaaagaggagcaaccttctcgtattacgtctcaggcatgctgaaggtgctctgaagatggcgtggttggtcagtgctttgggcataacccacctgtctaccttttggacattttgcctgataagtatggtgcatcttgtgtattttgatttataagtgttgctggttgttgactacataccgagcacccttctggttcttggagtatcaacatttcagcccacagactctcttgagttcaggcgattctcaacatcatgatagacaattttataaccg

SEQ ID NO: 90832 - DNA, 374 bp, Homo sapiens
gaaatgtcctgggtgcatagcatcaccactgtgtcatctacttgtgcctgcacccatgcaaacacacagggacacaaagctggaaaagggctggttttgagaaggagtaagcctgggcagttgaaacccaggttcggtgtactctagggcacttacttctaggtgactgtccttgccactgctggcgtaccaaggtctcccagtcatatgcccatgcactgtatacattttggcatttattctcatgaataaagtgtcattagaggccagacactgctggctaacgcctgtaatcgcagcactttgggacgtcaaggtgggaggactgcttgagcccaggagttagagaccagtctggacaacacagtgagacc

SEQ ID NO: 90833 - DNA, 225 bp, Homo sapiens
atatttttaaatgaaattcatcattttaatataaattacaattaattagaaataatgaaaattccaatattttacaatacttaaactaggtttggaaactaaaattgccattttaaacattacaaaaggataaccaaaaataaaatacatactcatttatttacatttacatttatttactctattttgagaatgcattctttcattgtgtttatgtttatactt

SEQ ID NO: 90834 - DNA, 578 bp, Homo sapiens
gctgggactcggccccacctaggctgggaaacgaagataggcaacgtgaccatggggccccggcagaagggaagtgtctggggcagaagcaggacaaagacttgctctcttggtcatcaataatatgttcataatagatgggggtcttgtgagggtgaaatcaaatcacacacagagccctcagtacagggtctggcactgtgtgagtgaacattcagcgttggctgttcttacaaagactcaggtggcagatatgttaggatgcaaaaacactgtcaagaagatgctggcaaggaagtggagaagtaggacctcccaccctgctggtggaagagaaattagtacgagccaccttggaaacagtttggcattaactagatgagctgaacatgcacgtaccttacaacccagcagttcttcccaggcacaatacctcagaagcacacaagcaatatgcacagcggcattgtttgtaaaagtcaaaaacggcaaacagcccgtttgtgctcaagagtagaataaattgtggattatagagtgtagtgctatacagcagtaaaaattaataactgctacat

SEQ ID NO: 90835 - DNA, 494 bp, Homo sapiens
caggtgtgagccaccgtgcctggccatagagcagtctcttccttttcctgttgggtctctgctcaaatgtcatgtcagagaggcagacctctggggcggtctatctgagggaatgcacccatctcccttcctctgaccagttagttaccttgcttattctttcaaagctcttaccaccaagcggccatctcgatacctgaaggacggacgacgcctccgggaaggccttggtcgcccaacagcccattgtgacccttctcatgtctggtcacacgacgaactgatttgtcctcagcacctctccgtccaccttcatgtacacagttgggcaccagcttcacaaagtattggaacatcatggctggcttggggcgcagtgacattggtgtggtccagggggttcagaatgcctggatagtcctccccaaatgcacaggtgcttggctgtagtgggtcatgttgatgtagacaagggcatagctctgcaagtcatg

SEQ ID NO: 90836 - DNA, 306 bp, Homo sapiens
aaaaaaaaaaaagccaaaactctatgaaaaaagtacacattttaatatagcattgggttaaattttcagagggaaaaatatgtcacaataaaggctaagttaaaaaaaaaaaggctaagttccaacaagcataagaaaaaaataaccaaatttcagaggtgcatggaacaaatactggggaaagatgattggaataagaaatacactgagctcaggggaatcgcttgaatccgggaggcagaggttgcagtgagctgagagcgcgtcgctgcactccagcctggcgacacaacgagactccgtctt

SEQ ID NO: 90837 - DNA, 297 bp, Homo sapiens
cttctccacagtaatgagttcatgtagatttggttcttaaaaaaggtctgggaccttccctctctctctctttttccctctcttgccatgtgacatgcttacttccccttcatcttccactgtaattgaaagcctcctgaggccctcaagtgaaggagccactggtgctatgcttcttgtgcagcctgcataactgcaagccaaataagccacttttctttataaattacctggtttcaggtattcccttatagcaatgcaaaatgaactaatacactagaatacagttaaaatagg

SEQ ID NO: 90838 - DNA, 671 bp, Homo sapiens
acgaaccgatggttgagggattgtcacgggaggaacatgacacccgaagagcctctaggtgcccttggagtgccacacatgcccagaccttctcacacccacacaaataggctctgccgtgcactcctacacacacacacacacacacacacacgcttgttcacactcagaacccaggacagccacagccaccgcttaggggaagccactgcagatgcccctggaatgggcacagcacagccagggcgctcttccaggcaggcgaggataacttgagagtttcctagggcaccagggacagagctcagaggcccccgaggtgtgtgtaggaggcggaggcccgcagagcacagagcaggagaagggcttgggccctggaggagaaagccattctggacaccaggggacctggacggagggtccccacagcccgtgccccacgccgcctggaggccagaggggtcagtggccctgctgtcccggctccatcttggttctagccgccacctgcatgaacacagtggcccggcttaacgcactaacccagcctctccctgtgtcccacagggagtagcaagacccaccccacactgccttcaccatctacaccagtgacgccgctgtgtgtcttagcatggaaataaataaacctgaatgtacgtgctcgcctc

SEQ ID NO: 90839 - DNA, 1298 bp, Homo sapiens
caaaaattatgttatactgcagtgtattgtacatgttaatttttaaaagtttgaactattatataatacaggtctcttgacttctcatggaaaaattattttttctattatggtgtgaaatattgtgtgaatatctaggcaaaacataacaatttggctcaattttcttctttagaggattcgtgctgtttttgttcataaagggtagtgaaatcattgaactatattttagaatgaaaatttttgattttattaaaatgattttttcaaggcagaaagtaaaaggaatgattgatagcggagtgcatatagagctagagcatatcatccttgaactctgcaaatcctttcttccattttaatatagcaagaacaattttgtctttactacatcttaaagaattagaacttgggttggtgtaagtgacttacttccagggaatcatgccctatttctaccagcaggtcatacccaaatgtcacactatctattgttaaccatgaatgatattcagatctattacttttcgtgaaaagtggaacatgttacttccaaccatggcctgtcaccgtgagtgtgatcagctttctccaaaaccacatgggtcgcaggagctaaggggtggtacccaaatgttaggaacagtgttaggaaagggcaagggaaaagaagtgactggatgtcttatgagaaaccggtaaatgactaaaaaaaaaagcaaatgactaaaaacatgactaaaaaattatatatatatataatatatatattatatatgtgtgtatatatatacacataatatctgcaaattctaatttatatatgtgtgtgtatatacacacacacacatgcacatacacacatacgtccagacatctccctcataaaataaccatcagtttctatgaaaaccttaagtggaagccaatttcccatagtaaataatttaggagaaaattataatgcttaaaatgttgctcaaacccctgacctattactaaactataattggaacagtaaaatgcatatatgtaactatcatatcatgatttaaaattgcttaaaccattgctgcttaatactaatcaaacttaacggctgctaacaaaagttgtgaattattacacggcctctttgtaacgtgctgcatgttttttaaaacatctctgtgtttctgtttgttccactgctggtatttggaatgtaatttaacagttctcacacatggtttggttataaattctgtattgccttttagggatataaatatacatttttttctatgtaaaaattagct

SEQ ID NO: 90840 - DNA, 552 bp, Homo sapiens
aatttagcgccgaataatgaacatacgaaattttgatgaagcaatatcgacgaagtgataacacacaacagattttaacgtggggggttttccacacacacacatgcacatacacacatacgtccagacatctccctcataaaataaccatcagtttctatgaaaaccttaagtggaagccaatttcccatagtaaataatttaggagaaaattataatgcttaaaatgttgctcaaacccctgacctattactaaactataattggaacagtaaaatgcatatatgtaactatcatatcatgatttaaaattgcttaaaccattgctgcttaatactaatcaaacttaacggctgctaacaaaagttgtgaattattacacggcctctttgtaacgtgctgcatgttttttaaaacatctctgtgtttctgtttgttccactgctggtatttggaatgtaatttaacagttctcacacatggtttggttataaattctgtattgccttttagggatataaatatacatttttttctatgtaaaaattagct

SEQ ID NO: 90841 - DNA, 397 bp, Homo sapiens
tgtacatgtgcctcatagcaaaattactaactgtatgaatcaaaaccttagagatcactacagagacatagacaaatccacaatgatatgttaacacacctttgcagtaatggatagaaaaataagatcaaaaactcagtaaggatatcaatcatctgaaaaatattaccaatatgacctatctgacatttataggatagtaccctcaacaactgcagaatacacattccttttaagagctcataggatgttcacaaaaatagatcatatgctgtgccataaaattaatctcaacagactttgaaagattgaaaatatacagaatacattctctcaacaaaatacaattaaattgaaaaccaataaaaataaaacatttagaaaatacctgaatatc

SEQ ID NO: 90842 - DNA, 178 bp, Homo sapiens
aaaaagatgatttctggggtgagagaggatggcaatgggcaatgaacaggcggagtctcgagctctctgtatggccctccaccctccccgtgcccaccctgcgtctgagggctgagctgcagttcagtgcagcagaaccagcaaatcactcctggttggttgagccattgcactccgg

SEQ ID NO: 90843 - DNA, 343 bp, Homo sapiens
tccacccctacaagttaaaggctcagtcccacaatacttccctacttcagatgtcagctgtaaatggggtgcccaggtgatccacatttctgcccaggtgactacaaatttgggggttcccatggccccttcccctcagtttctataatttgctagaatgcctcacagaactcagcaaagccctgaagcactgattattctcattttattataaaagataacagctcaggcctggcacggtggctcacacctatagtctcagtaacttgggaggttgaggtgggagtattagagcaggtagttagacgtgagcagggcagaagagggtccttccaccaccagg

SEQ ID NO: 90844 - DNA, 485 bp, Homo sapiens
aaattgttttttaatctttttttgtgtgtatgacaaagagatactctaaatgttaatactaggttttaaattaagcaatggaaaatatttagaagtataagcacatacattatacatttgaataaaaaattaagtgtaaacatatcttggttaatagtatcttgttattaaatcatccaaaaagaaaaatctgacagaatagactccttcttttatttaagttgcttttaaaacttttgttaactctgtaagaatgtttatttttatcttaggagtgggttatttttaaaatttttgagtatggaagccaaaaggcattttgccataggttttttaggtcagcctgtaaaaaaacctttaaaactataatgtatctgagacgtagtgatatttaaactactctgtataatagtggacttcaagtttgaaattgggatgtttctgcagtgaaactgcagattgctgctccttctgcttctccctac

SEQ ID NO: 90845 - DNA, 435 bp, Homo sapiens
ctcccaaccgcctttgtaggccccgaactttctccagccaagctctgagggcccacctcctgcctcctggtggcctgtacagttctagcactggttggagaacagcctctgcaggccccgcccttgcctcccaggggcctctccaggcccagctcttgcccccacggcggcctcccggggccaagtccctgcctgcctcccagcagcccgcgtgagggaggaacaggatcgcactcgggctgctgggaggtaggcagggacttgggcctgggaggtcgcggtggggcgagagctgggcctggagactcccctgggaggcaacagcggggtctgcagacgcccttctccagccggagctgggactgttcagtcactgggagaagggatgtgggtctgaagagcttggttgcagaaacttcggggtctacaaacgca

SEQ ID NO: 90846 - DNA, 831 bp, Homo sapiens
aataataagtatcctagtccgttcatttcataatgaacttcaacactgaaaaccttaaatgttgccattttctaggggagagtatattaagacatcagcagaaaagtactgctttcagccctggttggaggtgaatggtttctgtgcttgttaataaaaacgttaagagcttgggatgatagttttgaacatcagtgtttcaaagaaagtatgtttggatatcagtgtattttttaaatcactgttttagccacaaaactttagattttgttcatgtattgggaagcttatgagtttaagaaccgaaattagttttcttgggtaatttaaaaggtattaacaaggaacttgcctacaggagtgaactgtaggtaataaggatgtgaataagtacaaatattctttcatgttctcttccctcaaagaagggttaaatgacacacaaagctgaagtagggattgctctgcctaaattatgcagctgcctccaaggtttccaatagagcattgatgtagcctggcagggagattgtaagaaggcaagaacaactgttctggttagaactaatgagggggaaattagggtatggattgatttgtatttaattgtttaatgtatttttcggaagtaatttttttccctaattctacttggaattgcatgttattattaaatattaagcattgagaatggggcctgaatttaccactttattcagggatcgtgttccctgtttttagggccacttcttctccagtgagcccttcagtttgattggtgtggtgtggacaatttagatcaggcatatagtgggggaattataaagaggc

SEQ ID NO: 90847 - DNA, 603 bp, Homo sapiens
aataataagtatcctagtccgttcatttcataatgaacttcaacactgaaaaccttaaatgttgccattttctaggggagagtatattaagacatcagcagaaaagtactgctttcagccctggttggaggtgaatggtttctgtgcttgttaataaaaacgttaagagcttgggatgatagttttgaacatcagtgtttcaaagaaagtatgtttggatatcagtgtattttttaaatcactgttttagccacaaaactttagattttgttcatgtattgggaagcttatgagtttaagaaccgaaattagttttcttgggtaatttaaaaggtattaacaaggaacttgcctacaggagtgaactgtaggtaataaggatgtgaataagtacaaatattctttcatgttctcttccctcaaagaagggttaaatgacacacaaagctgaagtagggattgctctgcctaaattatgcagctgcctccaaggtttccaatagagcattgatgtagcctggcagggagattgtaagaaggcaagaacaactgttctggttaggatacagtagggagagtgtatcctctagagtcagccaacga

SEQ ID NO: 90848 - DNA, 509 bp, Homo sapiens
ggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggtgaagagaaagtaaaaggaagtcttaacaactctgttcaacatatacagcaaattttattgaattaaaacttggtacaaaaatttgtgctgaaactgtttaagaaacatttccttataatgttgccacaacacacaaatcaattgtggaaaatacttaaatataatttcttaaacattctatgtatcagtcttcattaataaatgacttaaa

SEQ ID NO: 90849 - DNA, 404 bp, Homo sapiens
gtccatctgcctgctggtcatctgcaccaagtggctcacaggcctaccacgtcacttcttccccaaactcatctgcccataaagtgcctaaaccaagttcaaaattggctggctctgggcaacacggaatcctgtttctctgtttatatggtctaggaaatgacataaagagcctactacatcaaaacacctgtgcagtgaaggacacagcagagtgatgagtacctgtggaatgggagaaaatgtctgcaagtcatctatctgctaaggggttaatatccagaacatataaagaacatcaaaaaacccaattaaagacatttctccaaaaatgagattcaggtggccagcaggcacatgaaaagatgccagtcaccacgaatctccagggaaatgcagttcaa

SEQ ID NO: 90850 - DNA, 2545 bp, Homo sapiens
ggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatgaagcttcaaatgaaacacttgtcctgccgacccctggcacggaaccccacaaatcattagcaggagcgcccaggtagctgagattgctggagaagaaggaacaaaaagggaatccttc

SEQ ID NO: 90851 - DNA, 478 bp, Homo sapiens
caggttacagatttaaaccctctaaaccagcaacttctgtagttgtaattgcatcatgacagactgtggaaaatacatgaagacctttaggtagttatcagacttacaatacagaaaaataatttcccagtcagcaaacatatgctcctgcactcttgcaccacagtccagttggcttgatctcttgattcaaggtgcacatctcttgaaagggtgcatctgcaattgcccaggacagtgacaaggcctttatgaatgaagttataactaggaaaccattctctcgttaggctggcagatacctaaaacatgttgataggattgttttatgccttgtcttctacacctcagtatcctttggattacacataatagcactatgggagttaatattgtcatcctttatttcgtgctttatgttgctcaagtacacaatttttttttaaggactccagatatctgctggatttcaggagtt

SEQ ID NO: 90852 - DNA, 522 bp, Homo sapiens
gttataatacacttagccactctttttctcagagccatttaaaaaaaatccagttaaaacattttatggttttcaatgttgccttattaagcaagcagtatgtgattgggcataattgtcctttaaggatttaaagtttgggttttccacctctctggcttcaggttactgaagtttttagtaagacccggaatggagaggatgtgaggataacgatcactttaacaaatgaacttccacctacatcaccaacttgtttgcagttctataatattattttcaggaggtatgtgttttatttcaacattttattaagaaaacagcaaagttgaaataattgtacattgaacatctgcattcagttctcctagattttcagcattggttgggattattgagtttctctgtattgcagtaacttaaggtgtggtttactgatagaaaattcatctatttgctttaagcaagtatcctgcctttacttccctaattctgttgacttcaaatactgtctgagcttgt

SEQ ID NO: 90853 - DNA, 3433 bp, Homo sapiens
ggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatatgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacattactatttattttgttttggaactgggacatgattctatttgttataaaataaaattgatgtgattgtcaccttaaaaaaataact

SEQ ID NO: 90854 - DNA, 2823 bp, Homo sapiens
ggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccagaaatgacataaagagcctactacatcaaaacacctgtgcagtgaaggacacagcagagtgatgagtacctgtggaatgggagaaaatgtctgcaagtcatctatctgctaaggggttaatatccagaacatataaagaacatcaaaaaacccaattaaagacatttctccaaaaatgagattcaggtggccagcaggcacatgaaaagatgccagtcaccacgaatctccagggaaatgcagttcaa

SEQ ID NO: 90855 - DNA, 197 bp, Homo sapiens
taaatgcagttacttactatagttacttatgtgccaaacataagtcttctaagtatcaagaatgacctcgcttgaatcacaattcaaatatagatagaattgttggtgttccatagcctgctgatatcagaaccctggacaatgggtttaatcaagcaacagtttgtgggtggatgggtccttctgtcaacatacca

SEQ ID NO: 90856 - DNA, 261 bp, Homo sapiens
gccacacatggagaactaagcatttggtccaacaggcagagtcaaggcttgagacatatgaccctacgggttgaaacatccacggagtattctaggcagctcctaaccatttgaggagccccaactaaggtcccagatattgcagaacattatgaaccatccaatttgtaccttatccaaatctctgacctaaaaaaattatgagctgcttgttttagttactgagtttgaggtcatttttacacagcaatagataactga

SEQ ID NO: 90857 - DNA, 494 bp, Homo sapiens
gccaacaattccttccttcaaggagctcacctggtgaggaaatagatgcaaaaacaactgattatagcatacagtgaaccctgataaaagtgtgggcccccaaaaaggagaggggctcaatgcttcctaagagagtagaggcagcttcacaaagaagataacactaaaactgaatctggaaaaacaatagcaattatccatattagtaaagagagaaagaggattccagtgaagagaaaagggtacccacagtcatggaggtcaggagaagcaggaaagggtgtacagggaagtaattcaggaaaatctacctcagaaggaacacgggaatgcacaacaaataatgtagcctgagagacaaggccggacctggtttgcaacaactgtttttgccaaaagaggtttgacatgatagagccatcgaagacgtggtgatgaggtgatcttcagaagatgagagatgaggtggatatcaaaatgagagagcaactgag

SEQ ID NO: 90858 - DNA, 462 bp, Homo sapiens
agatgttttttccttccctgactgattttctatcagcagcagttctcaaccctcatgtttgattccaaatcctatagcttgtcaagatataaaaatgaatttaaatatggtaggggaactgctgttttaataagccatcagttcgtttattttgtaaatttaagagtttttaaaaataaagatttcaaaggaggacatcatcatacttggctgctcttccagtgatgtcctcagagtcccgggtcaatctctgagtgtctcatgggtcgggatgcacctctgctctaggcagctgcagggcagtttacagagtgagcaacatccaccgggcggtggcagactggctccgtgtctgagctcacatcatgctgcacacctcactcacctgctggatcgtggaaccccagatgggcttcaagggacccacggtgggcaggaggcaaaggttcccagtgccaccca

SEQ ID NO: 90859 - DNA, 822 bp, Homo sapiens
ccagaagatacactgtcagatgtgtaaagcaaggtaaggtgcgcagagtgagccttctgctcactttgtataaatgtaaaggataaagctggtaaatacatgcgcctttaacttttttcttcaaaacctaagcatgaaacacaaactgctacaggaaggcttgacaagaggggagtttttgctttttgtttataataacttctgtatttcttagcacattcagtatgtgttcttcttttcactagtgtcaacagagatacgaacatttaaatttttttaaaaagctttaggatagaaaagaggtgtagctgggcaatttcctttgacatgcggtttgtctgaaatagagcagccccttgtttatgatttccagatatgtgagtctgtttttttatgtacaggttttaccttggctcaatttactgtctagttacattttaacagctttctactctgctttttctctcaatataaaagtaatcgaaagaagactaatcatttttgaaatgctttcagttttacacagttctgtgcgtgaaagcctggtgtccccaccagccaactgtgggaatccaggacatagagcaggaatagctgctgcttatttactgctctaattacctcttcggttccatttgcggtcgctagttccttccatcaagcaaagtgaaaattgtcaaaacggctgtttttccctcctggaaaacagaaaaaagaatatggcaagatgttaactgtggcatgacagtccgggattctggacacgacctacataatcttccttgtatctctttgtgacttggtttcctcatctgtaaaatg

SEQ ID NO: 90860 - DNA, 413 bp, Homo sapiens
gtacttctgagtcctgtaattaccaaaaagatagtcaatgtgggggaaggggaaactaactaactattaagaccagaggttataatataaagaaattgttccaccttgtagattggtgtcatcagattcctgagaaatctttactaaaatgaattgtaaaaataactacctgaagaacagtatcttctattttaaatgctactgaatgaaagagcatgtttttgttgatgaagaactcacacctcgctattaaacatttgctgatgaatatatgtgatccaaactcagaggaggctattcctgagggaatgcccagcctggtcttattgtggacatgtgtgagatgaacactggtgtgagagatggtcactctccaccagaactgtcctcatgcgtgctgcattgcagagaag

SEQ ID NO: 90861 - DNA, 703 bp, Homo sapiens
attgaggggcccgggctgtgaagtgtgagccacgtcggtcccaccatccccaggccgaccagcacagctcccaagtcaattctaactgactgttcagacaatgccacgtgcgtccatgtgtgctggtttatcaacccccaaaaagcctctgccgcttggttccaggacagctcctgtgatggccccatgacaccaggctgagagcggggactcccatgtgaagtggcctggacggagcgcacagctttgcaggccggctggagctcccagctactggagaaagaggatgtggagctgaggaggactgagctttgggtgtttcctgttgtggaacctgtggcggccagggctgtcagagtctgtgtgtgcttgtgcagtgaggctgggcaccaggggtctcctgtgccacgccatgtggcctgctggcgtctctcacgctgtgtcttggcacagggagctccccatgatctcagggcaggtgcagtgagaggtgcatcccccccaccccggggggtcgggtgggtgagctgcacgtgccggtagcattgctccccagggcctggccaggaggctgaccctgcacttggggctcggtggtgattctcgctcctcctctgccgagacacggaaagtccaggtgggctggggctgagcagcacctgtggggacctgtccgctcttgccgtgacagctcttctacccc

SEQ ID NO: 90862 - DNA, 1049 bp, Homo sapiens
agcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggtgaggagctagaccacactgaggcggtggtcgggactcagagtttgctcagtgagccgttcactatgtgcaggggcagttccccgtctgaatttaggtgacgacactcaggtccagccttgccagtctcagcctccggtctccgttccccctctgcagaggccactttgtctgctgcacgtgatcatgaggggttgtgaagtgcttgccccatcagtagccatgtgtgcatgtgtaaataccatcctctgtgtgccctggaggctgtctttcagatagcatgtacaggtggcagcatagggcctgtccctactgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcaccgacgcccaggaccctggcctgcagagacgcccccgccacaggatccagagcaagcagcgccccctggacgagcgggccctgcaagtctgctggctgcgcacataacttagcctgtcacacaccaggaggactggatactggggaggagccggggccaccaagggttctgtccccca

SEQ ID NO: 90863 - DNA, 725 bp, Homo sapiens
  misc_feature (448)..(448): n is a, c, g, or t
  misc_feature (477)..(477): n is a, c, g, or t
agtctagctgcagaggccagaggaagtcattgctgtcctgtccctcccgaaggttttctggaccagtctcccagtgaggtgcctggtctgagagggccttgaccatgccccttgggaatctttcagatccccggtcttggatgtgctgactgacacacccagacctatggggcttcagccttacgtagactcactctgttccagtgaagctggacccactctgacttgcagggcaacatcagctctagccactgcatcctgacctggagcatcggtcctgccttggagtcgaggaccacacttctcagctatgacctatggccttcgagaggcaggaagaggccagaaaggggcccccctttgggggggggcggcaaaggggaaaaaaacccccccccccttttttttctctgggcggacaaatttggggggcgggggggccccaacnaaaggggcccgagctgtagctgatatgangccccaggactgtgctggcaccccacagggagccttggagccctgcgtccaggaggccactgcactgctcacttgtggcccagcgcatccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctga

SEQ ID NO: 90864 - DNA, 734 bp, Homo sapiens
agtctagctgcagaggccagaggaagtcattgctgtcctgtccctcccgaaggttttctggaccagtctcccagtgaggtgcctggtctgagagggccttgaccatgccccttgggaatctttcagatccccggtcttggatgtgctgactgacacacccagacctatggggcttcagccttacgtagactcactctgttccagtgaagctggacccactctgacttgcagggcaacatcagctctagccactgcatcctgacctggagcatcggtcctgccttggagtcgaggaccacacttctcagctatgacctatggccttcgagaggcaggaagaggcctgggaggtaacgctttggctggcttcccctgggggcctccctcctgggagcagcagtccagggcaggctccccactctaaataaggagaggtcaacttggggtgaagaggaggggaggagctagagccagacgtgtgtgtgcacatgctgacatgcacatgtgtgtgcctcgtgtgtgtatgtgagtagggtgagtgctcctgtgtttatgtgtgtgcacatgtaagtgtgcccgtgtttgtgtttgtacatgagtgtgtgcctcgtggttgtatacgtgagtgcacttgggcatgcctacaggtatgagtgtgtgtgtgagtgtgtgtgcaggggtggcagaagtactgtgggatgggacagaaataagaaaagatggaaaaaaaaaaa

SEQ ID NO: 90865 - DNA, 770 bp, Homo sapiens
agtctagctgcagaggccagaggaagtcattgctgtcctgtccctcccgaaggttttctggaccagtctcccagtgaggtgcctggtctgagagggccttgaccatgccccttgggaatctttcagatccccggtcttggatgtgctgactgacacacccagacctatggggcttcagccttacgtagactcactctgttccagtgaagctggacccactctgacttgcagggcaacatcagctctagccactgcatcctgacctggagcatcggtcctgccttggagtcgaggaccacacttctcagctatgacctatggccttcgagaggcaggaagaggccggtgaagagaatcttctaccagaacgtgccctctccagcgatgttcttccagcccctctacagtgtacacaatgggaacttccagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcaccgacgcccaggaccctggcctgcagagacgcccccgccacaggatccagagcaagcagcgccccctggacgagcgggccctgcaagtctgctggctgcgcacataacttagcctgtcacacaccaggaggactggatactggggaggagccggggccaccaagggttctgtccccca

SEQ ID NO: 90866 - DNA, 310 bp, Homo sapiens
caacacccttgttgctgtgtccatctttctcctgctgactggcccgacctacctcctgttcaagctgtcgcccagggtgaagagaatcttctaccagaacgtgccctctccagcgatgttcttccagcccctctacagtgtacacaatgggaacttccagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccggat

SEQ ID NO: 90867 - DNA, 661 bp, Homo sapiens
attcaaatccaagtgtctggttttaaatgaccagcttattaacattgtgtatagagaaagtaaaggagttggtgtagtatttctcacataaatactgcgtgtgaatattgcgatacctttgggttgctgagaggctttttggcataattcctgtttctcagaaaagtttcagatggctgagtttggtgggtaaatgaatttgaaatagaacccagcactgtccctgacacatagcagaggcctaataaatatttatgattcaatctattcattaatgatttacttgctggtgaggggttatgctgtcataccttttaaaaggtagactagaagcatgatggaaaatgcatgggctagatttggaattacagggacctatgttcaaatctcggcttttgtgcttactagctctgtgcccatgggtaggtaggttaaatatttctgtgcctcagtttcctcacctgcagaatgggaatgatgaatatctctatagtttatgtgaggatttaataagttaacacatacagtgcacttagaatagtccctgtaggtagtaagtactagataaaagctattattttttattgtaagcactcaaacaaataagaattattagtaattgttactgcatgctactagggttgtgtcaatgatgctaaat

SEQ ID NO: 90868 - DNA, 542 bp, Homo sapiens
agccaataagccacaaactgatgataagtgtcagacccggagtgcctgctagtctagcacgccacccccgctagcccggccttccagctctagatggatgtatgcctttccacaccacaagcgaaagtgctgggccagggaatgtggtttccctctctgtatccccagggccttgcccagaggctgacacataatgtgtggtcaatagacattgaatgaataaatgagtgtggtaagaaaaaatacagtgtggcatgggaagacttccaatttcagagccgcgcagttcccttgcaaagtgggaaatggctccacagcacagccctggggctgctgacgtccaggccaggaaccataagaggtgagtggcacagggtgggtgtggctgctcagctcaggttggcctgggcagcacaaggcctgacagcctccagtgcccacccatcttgcacatggtgaccataccaattctcttagcctgctccctacctctgtcattcttatcctccaccatctgacctgacctatacccaaatctcagg

SEQ ID NO: 90869 - DNA, 257 bp, Homo sapiens
cagtacagtttttcttcaagggctccttcataaatatatgcttgtaattaagatccaagttcaaatggagggttgtcccttggaggacaaagccagagcttgcattctgggttattttatcagtgaaaatgtgcaagtcctatgagctcctgagtccgacactggatcatcattcaagggcctgcccttgggttcttcgctgcatcctggccgatttttgctcctatcttgacttcctggcccagtcctttggtggc

SEQ ID NO: 90870 - DNA, 451 bp, Homo sapiens
tgatgaaatggccacttcacttctatgtgttttgaaacatgtatgtaaatgtaaacatgttaaatatgtgaaataaaatttttcctcctcagtaagttgaaagaaatttccatttaacgaatgattttttaaaaaaaacctgattctaaagatatatatggtgattgtcaggccagtcacaatggtgcacgcctgtaatcccagcactttgggaggccaaagtgggaagatggcttgaggtcaggagtttgagaccagcctggacaacacagcaagacccatctctacaaaaaagtactttaaaaattagccaggcatagtggcacttgcctgtaatcacagctactcaggtggctgagatgcgagggagaatcatttcagttcgaggctgcagtgagctgtgatcgcaccacttcactccagcctgggcaacaagcaagactctgtctct

SEQ ID NO: 90871 - DNA, 413 bp, Homo sapiens
gcctaatacaagggccagttaccagactctgaaccacttactcttaacaaacagcctagagcctgcccacccaaaatacagcactcacacctccctccaccgtcagctatgggaatgatggaaagggaagtagggtgggccaggaaggaatcaaaggaccaactttccaggccttgggaaacagatgaaaaggatgcaggtcatctcaggagggttgagagtagaacaccaggtccctgtgattaaagggtcgaaaacctagcagtgcacaaaaatcaaaacatcttggttattttcctgtctcccactactgacatttttgtctcttacatcattttatccaggggtacaatgggggcgtgggggcagggtggggatctgacttatgggaaactgtgagggtgagtggaatc

SEQ ID NO: 90872 - DNA, 504 bp, Homo sapiens
atatgtgtgcattaaatatcaggcaaataaccaaatagctactactaaaacatgtgactagagcaaatcacttaattgccagttgctctgaattcaaacgtatctctgaaaacacttatcccattgtatgaagattatgaaatagcaaaataaaattgtcatcaagactgttgaaaaagtgattatttaatacaccaatctctacatcataaggagaaagttggagcaaagaaaaaaaaactgtagcctcatgaagatatacattcagtaaccattataaagatacggccaattttctctctagagtcgatcagacagacatttccctacaatttaggtcaataacttaagttttttagtttctactaccttttgataaagatcagctctaatataaagataaatatgaagaagtatgtcaagcagtgtgattaggtttcaatagctggccttcaaaactaaaaattcatctcacatttaaaaaactttcttggccaggtgtgg

SEQ ID NO: 90873 - DNA, 479 bp, Homo sapiens
ggaatcaggaagagggcagtagagggagtgagacatggttagattctggaaatattttgaaaggatcagctgtgggatgagagagagggcaggttccaacatgatttggtttttggcctccgcgtcctggacaagctgccactgcctgagatggagaaggtaggagaggaagcttggggtaagattaggagttcagatttgaacgtggggagttcgaggtgcctcttttctcccagagctgggacacagcaggatgcagacacctggagttctaggactggtgagggcatttgggaattgtcagaatacagctggggtttaaagccaggcaagtggatgagaaaagtaagggaagggaaacgaaggggaaggggctaaggtgaacttggcagtgtgaggtgtgaggtccttggtggcatggagcagacagctcggcttggagattcatacaccttacctgctgtggggtcatgaggagt

SEQ ID NO: 90874 - DNA, 1641 bp, Homo sapiens
caaaacttgaggaagagttagaatggtaataaaatattaaatagaccttatacttaaaataaggtttcactatataatttgtcacaattcaatctaatcagctaaagttaaatgtagttagaattagccacaggagaatgtaaagcatgctttgacgaagctatcggtaacacatattgaatgtctttgagactcttagattgtactatttgcttaatagattaatgaaatttatcagatacaacctgtatttccaaaaacaagctagaaggaacctgaggaatgtggtttacatttgagatccaccttactgtgttttctactttcagaaaagattctgtagttttggtttttggcatctttcttatactcagttttttctgccttaattcccatttaccagcagttaactcatgtttattgtgctttcatgcattgtgatatggaatgtgtttagtaatttactccttataaatatggtaaagtacagtggtatggttattctatgcattaagttaatgacattaataagcttggttatgaggggttggagccatacatgtaatttaagagaacagttaaaagtgtaacatagttttagcttggtgtctaaataatgggcagctgataaaacagcttggaccatattgttttaaagagagcctacaagcacagaaactagttatagatctaatgtggaattgctgaactcagaactaggccatggaagtctgaaaagcaaatatggctgtttcaaactcatttttttggcagcttttttatttttaacactttattgaggtataaattgacttgaacacacaggtaaaacatacagtttacagtgttttgacctacaactaagtgaacataatctattattcccccgaatttcttggttccttttaagtccctgtcactaattctccacccccctctcattttattttggtataaaatgtaattaatgagcaaaattcttaaggtaatgacttaaaatagcatttcaaaaactatttgcttgattttagtataaggattagaatatttctgcagataatttctattgaaattgttaatctaaaatcagcttgacttaatcagatttatattaacagaattcagtatgttaaaggatctggttcccccaaaatactttgtccttttttgctagtgtttatgtatactgttagaatgtggttatataaaccttttaaatttaggaatctgttaaataacttgttttaacaccccatccgtcgtcatccctaatctgatactggagtctaaatacatgctccataatcatgcaaactaagttgaatctagatgatgagggtagactgggtgcggtagctcatacctgtaatcccaggactttgggaggccaaggtcagcagatcacctgaggtcaggagttagagaccagcctgggccaacgtggtgaaaccctgtctctacttaaaaaaaaaaaaaatacaaaaattagccgggcgtgggggcatacacctgtaattccagctactcataggatattgaggcaggagaatcgcttgaacccaggagtcggaggttgcagtgagttgagatcgtgccattgtgctccagcctgggcaacagagtgagactacgtctcaaaat

SEQ ID NO: 90875 - DNA, 482 bp, Homo sapiens
cttgatactcacagctcttcaaagacaaagatggtgacttatgtgtccttgtactatgatacttagctggcatattagttaaagcaaaaataccaaatatcatgagtcttaattaactttactattatatgttatcatatacactcttggtttatacgctagtacactttttcattttcttaatacttatacctgctagggatccttcacatttgtttaatacagtccatttaaatcacaggtcctatagcaccttctgtatgctaggtatcgtgttaggtactaggaatgtaaaaatgagtaaggttcatccttgctgacaaggggctcacaatggaggagaaaagacagataaacagatacctgccacaatttctactcagtacaaagtgtgatagatgctatgatactaggaagcccagggtgctttgggttagcatatgcatgacggtcatacataatagtataacttgcctagttgc

SEQ ID NO: 90876 - DNA, 1255 bp, Homo sapiens
aaaaaactttaaacagattgaaataaaacagaaaagtaaatgtttttaaaaacttccttaaataacttattgctatgatatcttgtttaacattgtgatattgtacagaaccagagtttgtctgtagtatcatctagctgtagagtaccctgcttggccaaatgaatcactttcatttgtccagtgcaactgaaaatttctcaaaaaaaaaaaaaaaaaaaaaaaaccacctacccagtaggttaatgcatactaaaggtatgaatgcttaagtattttcttcagtttatagtgatatttctgtgtgaatgcccctgtctttttgtttacaaaatggagaatacaaatttgaaacctagtgaaagatggcaactatcaaagtgttatcttagttttaaagaagcttgggattatgttaatatttagggaagttttatttggattccttgaattagttaccttttgaggcttatggattcttaaagcaataaagcaatattccttttaaaatcattgtttttcttctgtttattaatcattgatttaatctgtgtttttctgttggattagagaaaagatttacctgagaatcttgcaatctctatatcattagctatattataggtagagcttctttgctttatctgtaatctctcctgaacacgttgctttttcaggaatgaaaaaaaaaagaagctgcagaaaggggtacaaattaaattttcatgaaagaaaatcctaatcagcagtgacagtgtaagagaaagatgattgccacttggtcattgtggagaggcacttagatttggtgtcagtgcttctgttaatgatgactaatgtctttcttggagcaagtgcatgctcaaacatactgctacagcatatagagggagaggcctcagtaataggcatcagtaagcaaaagcattagttgtcttaaaacaaagactttttaatacagtcaatttgacactctgtattattagaaaaatacaaacataattctaaggcatttaaccacaaattttgaactattttatgttcagtactaagaggtaatattttttaattaaaaggtaatgaaaccaaggaatgttaataagatatgctctctgttttgtcacttacaggaatgggcacctacattgcactgcacagaatcacatgtgctgagaaagttttaaaaagaagccaacttacaacagatttttttcataccctagtgatgtattctgaacaaatgctttatagttac

SEQ ID NO: 90877 - DNA, 253 bp, Homo sapiens
agactatcaaactaggtgaagaagtgagatccaattttatgctgtccacatgtttttcaggggcaggaataaaagaaatacttaagaatacagaatatgggaaaaatatggtttcccataatttaaaatatttaaaaataggaagtttgtaattattactgttgaatattcagttaaagtcaatgattcttttgaccagtatacctactcccaatttttctgggcaaatcccaactatacacctctgtctaga

SEQ ID NO: 90878 - DNA, 384 bp, Homo sapiens
tggagtgcgaggggccagtgtcctctccccggggggagactccagacacaaacgcggggcctgaggcgctgggaggcccctgtgcgagccggatggcggccagagaggacgtgtcagctcctcgtgggactgaagagcgcgaccaggcagagggtgggcggggagcctagggtcctacacaccaagcacagcgacgatcgtggcggggaggggtctgcacacctactgggggtggtgcgagtgagcctttctaggaggcagctagcagataaaggtgtggagcccaggggatgcttcctgcaccaggcgacaggtttggtggcattggcgcacggttggcgtggaagccaagtttctagagggagccgacaagaagctgagtgt

SEQ ID NO: 90879 - DNA, 663 bp, Homo sapiens
gtgttagccaccaggcctggcctgagaaggtgtttttttttttttttggtcttgttttcccttacccctttctttgaagaaagggtgtcaaaagacattacctgcctctaaagccagatatcaccagcagacttcttaaagtggacataatcctagagctttcattctgtttagaagttcatgttcatcttagccatttggaacttcttcattctctatcttttctccacggtggctgggcttgtctgcaaatcattgtgtcaaaatcaaactattttcaaaacagccctttgcttctgagcccctcccctaagtcctctgtgggggtccatgattctgcagaggtatgggacagaatcttcagattttaccccttgagtctcttcctagtcatatcctggttccctcattctaatattgacaaaggatgactcattaagtgcaactggttatgtaactttcaaatactttcattgtgtatgtcaggatctgaggaacaaaatgatgtcatttaatcggaatctaaatgtgacacaaacaacgtgccagcaatacctgcttgtgaaataatgttctgagcccacagtgttcctgggtatgtgagtttatatcaagtgaaaaggctgcttaattgacattaaagttttggaatgtaaagcttca

SEQ ID NO: 90880 - DNA, 683 bp, Homo sapiens
gtgttagccaccaggcctggcctgagaaggtgtttttttttttttttggtcttgttttcccttacccctttctttgaagaaagggtgtcaaaagacattacctgcctctaaagccagatatcaccagcagacttcttaaagtggacataatcctagagctttcattctgtttagaagttcatgttcatcttagccatttggaacttcttcattctctatcttttctccacggtggctgggcttgtctgcaaatcattgtgtcaaaatcaaactattttcaaaacagccctttgcttctgagcccctcccctaagtcctctgtgggggtccatgattctgcagaggtatgggacagaatcttcagattttaccccttgagtctcttcctagtcatatcctggttccctcattctaatattgacaaaggatgactcattaagtgcaactggttatgtaactttcaaatactttcattgtgtatgtcaggatctgaggaacaaaatgatgtcatttaatcggaatctaaatgtgacacaaacaacgtgccagcaatacctgcttgtgaaataatgttctgagcccacagtgttcctgggtatgtgagtttatatcaagtgaaaagggcgtgcgttgatttgaacaatctagcagcttgttgggaatgtgaataggcataagaaagg

SEQ ID NO: 90881 - DNA, 320 bp, Homo sapiens
tgggaaatattacaccaaatagaaaccaatgcatcatggctatttatattaggtgaggtagcttaaaaattcatttatagagatttctatattcatatttttctttctgcaatgtcattttggtctttatttttggacacatagcatgttttaataaatcagttttacatgtgtaactttttataacatcaaaataaacaaaatatacttttcataaattcctcatcactgtgaatttactttcaaataaatgtaagtagcaggtggaacaatgtgtttctatatacgaaccagtgcaacactgacagtcacaattaagg

SEQ ID NO: 90882 - DNA, 171 bp, Homo sapiens
gcttctaaattggaatcttaccaaactgagttagatgaaaaataaagctctttgattctttatgttctttagtgttgcaggacacacagaagtttttttggcttcttttgcttattatctactttgtgcttattatctactttgtctccctggtgattaagtaaacccatg

SEQ ID NO: 90883 - DNA, 348 bp, Homo sapiens
gggtacatgtacaggtttgttatataggtaacttgcatgtcacgggagtttggtgtacatactgtaatatacaaacggcaaataaacacatgaaaagatgctcaacatcatgtcattaaagcaataaattaaaactacaatgaattgccactacacacccattaaaatggctaaaatccaaaagactgacaataataaatgctggcaaggatgcagaatagcaaactctcaatcattgttggtgggaatgcaaaatgatacagccactctggaagacagtgtggcagtttcttataaaactaagtataaaacttaaccatatagccagcaatcatatttctaagtatt

SEQ ID NO: 90884 - DNA, 247 bp, Homo sapiens
ttcctctcctcccacctccaaggctgagcagggagttcacaccactgtgtactccatgagtcagaccattatctgcagcaacagagagtttcttccagtaaacaaggatcaaatatataaccatcacattgtccaaaactggctcttacctgctgtggtgtcctctgttcctgttgtcttcatagtttttatctttttaaattcctttactgtcatgtcatagggtttgggggaggaatagagatag

SEQ ID NO: 90885 - DNA, 449 bp, Homo sapiens
cagcttaccggtgttatcgatgccaccatcttgtggtagatggtggcaccaccctgaatagggtaaaaaacatgcaattgtacatcttcagtgtgccagttgtctggtacgggaatagtgtcttaaagttgttaataaaaatatagggaaaatggacacgacaccctaatgcaagccccggccctgaactcggcctgggaggaggaaagacatgccgcaaagctcacagctgggtcagggacagccttgagtgtggctgagaagcgaggaactgcctggatgtgacatttgccgacttggatagccgggccatgatgcgtaggagaatatctgctcatagaaatatctgggccgtatttggtgggaaagggccatggtgtatatcacttatcctcagatggtttagcaaaaactctgtgtgtgtttgtaaagattgggaggtgggcagt

SEQ ID NO: 90886 - DNA, 491 bp, Homo sapiens
ctgtggtcctcaaatatgtcattatcataggagataaaagcagtggaaatgtctcattccaagagactaagggtagtgagtatagggtaaagggcacggggagatggaatatcctaaaatcatcttgtggtagatggtggcaccaccctgaatagggtaaaaaacatgcaattgtacatcttcagtgtgccagttgtctggtacgggaatagtgtcttaaagttgttaataaaaatatagggaaaatggacacgacaccctaatgcaagccccggccctgaactcggcctgggaggaggaaagacatgccgcaaagctcacagctgggtcagggacagccttgagtgtggctgagaagcgaggaactgcctggatgtgacatttgccgacttggatagccgggccatgatgcgtaggagaatatctgctcatagaaatatctgggccgtatttggtgggaaagggccatggtgtatatcacttatcctcag

SEQ ID NO: 90887 - DNA, 542 bp, Homo sapiens
cttccttttatctcccatcagccgaaactaactctgctgtgtcacgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtggcccagcaacttccttccccgatgatggccaagccttgaggatgtgaaactgcccagtgccccaatctggagtccaccatcctgggtctagctggggacatccttgaatcagcctctgggaatcactgaaccaacatgagtcacttgctactgtgagatctcaaaacacatggatcaggacagagggcagggctgtttccccaaggaaatccaaatgctttacaggaaggggagtggatgctggcccggcccaggcgaggatgaggagtaactgagctgcagaccattgtttagccctccttcc

SEQ ID NO: 90888 - DNA, 968 bp, Homo sapiens
aaactgacggtgctgtagaacaggatgtgcgagaatgctgtttggcaaacaaagagcgctctctggcccccagaggttctggcttttgagcccagactaaagaaagccaggctggagaccgtatatcaaactttgcaagcccgtttatataccttgctggtgcctcagggggcagaaatgctggttggggatctttgtgttttgttttgaaagagtgatgtttggaagcagaagcactcaaaaatatatcctgacctctggcacttagaacctccaccagagcttggcacttaactgttctgtttctcgtgatatgttctaattatctgtttccagccagattgtaaggtcaacaatggtagtttatttacgagtaagtcttagttttctcatctgtaggaatggggataaaaatgcaggtttgctatgagtgttaggggttcagggtttagttttgggcctaactgctcctgtctacctgtctacccttccagggcctctcaggacacaccttactcccaaagcacaatatccaaatggcaaagaggttgtccctttcttaatgagctccacaagcacctgaccaccaccccctcccattcgaggcctccctgtcccctcccgctgaacctaaaccgctctgaggagcagctctccagccatcagtcctgcttggatgaggatgctgattttgtgtctagggaaacaagtctgccccgtttgccttccacatggaggctgagagtacaagagaaagttgggggaaatagcaagcaaagttcagagggcagtggtccattttttcttatcagccacaacaaaaaataaataaaagaaggaggaggccgtgtctttgaggcacagtaagcctgcccactgaatgtccctgagagtaactagttatagactctctaaggagatagacggagagagaggaagacggccccgtgatgaaaaccctgctggga

SEQ ID NO: 90889 - DNA, 164 bp, Homo sapiens
tcaaggagtggggtaatagactcatgtcttaatgcgaggagctgtaccctattgaggccatttttgccatctactacaacaagtgatttgctcatgccctccccacttggataatgggcaactcacaaaaatcttggtttcctgactaacagaacaaacctgga

SEQ ID NO: 90890 - DNA, 438 bp, Homo sapiens
atttgcccaaggtcacatactagaggtagcaaaaccagctctaaatattctcaatccaaaataaccacctcttctgctattccatatagccttagcctttgagaaaggcagtagtacttttccccattattacatatgaaaatggaaaaatcagagtgacttccccatgtagtttctttcccataaattacagggatggatagatagatatggatatatacatatattgcatatatacacttaaacatattaaatatataaagtcttaagtttcatttcatatatacagaaaatggaacctgcaaaggaaaatattatttgaaatggaggtgattgtgaacaacatccatatgtacttatcaaacttaatccactgactaatataatttaaggggaacaaagctttcttttggataaaatggtacacagacatagaag

SEQ ID NO: 90891 - DNA, 425 bp, Homo sapiens
ccattattggccccactgtcagagtgatgcagacgatcagaagaggaagaggaggagggatgggtcaggtagagctaatgacaagagagtgttctccagggtgattctgaatccttctccctgtgctacaaggaccaagttaggggcaactctcagcaatcttttcttttttcttgtggatagaatgccatcaatttgcaagttactttaaaaaatggaagaattgtgcctactgatgagaggccaatgctggcagtgacagcgggatctgagaaggcaataccgtttaggaagtctgccacatggcttacagggtagaggtagagagctttgggtttcaacagcaccacgaataactttttaatctggctcctttctcccctgtgccagagcactctctgctctgcacagggccatcagctcac

SEQ ID NO: 90892 - DNA, 577 bp, Homo sapiens
cataaagcacaaggctgtgcatgactagagtcccacctaggtgtctggcataatcagacctcagcaaatgcctttggggccttcccacagctctgacctcgatccactggggctataccctgccctgagaaaaatgagtaaataaagttataccatccactacctcatacaccatataagaaaattaactcaaaatggatcaaaggcctaaatgtaagagttaaaactataaaattcttggaaacttagtaaacgtgacaatgggatatgcagtggtttcttaaatatgatatcaaaagcacaagcaggtctggcatggtggctcaggcctataatctcagcattttgggaggtggaggatcacttgaggctgggagtttgaaaccagcctgggcaacatagcaagaccctgtgtctacaaaaaatttaaaaaaaattagcctgtagccctagctatgcaggaggtggaggtgggagaattgcttgaacccaggagtttgaggttacagcgagctgtgatagcaccactgcactccagcctgggccacagagcaagatcgtacctcttaaaaaaaaa

SEQ ID NO: 90893 - DNA, 392 bp, Homo sapiens
ctggcttacatctagggtagggtttcacaacatttgtcctcttgatattttggaggatagtctttgaataatcctacccgtacattgtaggatgtataacagcatctctggtctccactcactacatcactgtaacactcttctaattatggcaatcaacgatgcctccagacaaatgccccctggggggcaaaatctccatggttgaaatacaccatggagattttgaactcacctagggtaaaatgtaccagctaacttctaacaccagaaatactccaagccaccacaaacctaaatctagatgcacacttctacaaaggatattaaagaggttcatctcgcacctgtccaccacctggtatcttcttcagtgccccaggaatggcctt

SEQ ID NO: 90894 - DNA, 318 bp, Homo sapiens
gtctttcattttttacacattgtcaatatttgaaaataggatcactgttggtttagactcagtgctcatctgcatgatcagcctgtgtcatttcttgcgttaggccttacctcctttcagtgtgttgattttctaggttttatcttttctcatttagaggccaattattcttttttctttttgtttcaagcagttttatatcaccacctgttctttccatttcagaagttcattttctgatataaagctaaatagttttgctgacataagttcttttcatcttctacagcaggttcagtgttttgctcataaagagaa

SEQ ID NO: 90895 - DNA, 525 bp, Homo sapiens
taaatataattgattacagtctatatgaaatgaataattaccttcttcaccagccatcattttgtatttgcatttgcctttgaatacatttgcatgtgtgaggtttgtctaatatgcattccagtggttaaagaacaggaaataatcctgaaatcaaagcttggagacgggttatttgcccttgagttccaggactcctgtgtgtttggaattgttttacataaatccatgtcttaatgagtacaagattgagtttttttgcatatgcttttatttcacttttctcaaccatagcttatgcttaaaccacaatttctaagtcaaaatctttgaaaagctttgggttaatcttctcaagccactgatttatttaaaccaactacagagaggatgtagagatgaatcaaatgaaagggcaacaaacactttacagagtttaaataaactaagtgagagggaaaggttttaatgttgaaatacttaaataatgacatttacctagtaatctgccttgcaaaaaaataa

SEQ ID NO: 90896 - DNA, 1093 bp, Homo sapiens
  misc_feature (1061)..(1061): n is a, c, g, or t
ccctaaagaaagctgtgagaggacagagatgggtgaggaacgagtggcctctgcaacctgagatggccacattgcaaactctttcttgctgcggaacttcttctatttgctaaggaactgccattacactggtgtttacacagcaattccgaaaggaaatggcatcaaggcaaaatcttgatgccatggaaggcccttggaatgatccaattcagtggttttacaaacccaccacaaatgcggtgcctcggcagacatttgaaacctctcatctaacccgacttaagtgttccttgccttcctcagggattcctctaatttgtgaagtcactttgaaagaatgcgtgcgtgtggcaggagggagcgtgtggtgacttggtcactgccactctggttccaagttctgttttcaggagggggacaggtcagattttcctccagacataggtcacttccccagggtcggagatgaacttaaaggctaagaaacccagatttaaggtcaaaaccaggagctggaagaggaggaaaagagagtggaaggggttaagaagcagctgggcaagagcagaagatgctccagcagggacagaagcacgacctggccctcctttccatttagagcacattccatctggagaggtcaaccgaaatattaatcatgtggacaggagaaaaggatgtgaaaaaaccatttctcttatctcactttgaaatgtgaaagtgcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcnaaagctgaaataattgagtatgaagccctaag

SEQ ID NO: 90897 - DNA, 368 bp, Homo sapiens
atcttaaaaatatatgcaaatcaaaatatattcatgttcattttaatattaagggaatttccatttccaaagcatcaccgcccatcacagtagttccacggatcccagcttgagaactattaaatgaaaaaccaaaaaatgcaaatagcaggatagaaaagttgtaggtacattaaaatggttacacctaccaccaccactggggaatcctgtaagatgttaatggctgggaatgggggctcacgcctgcaatcccagaactttctggggccgaggcaggcagatctcttgaaccctgtctctacaaaaaatagaaaaattaggcggacatggtggccagtgcctacagtcccagctacaaagtgggc

SEQ ID NO: 90898 - DNA, 305 bp, Homo sapiens
cgaggatctgtgggcagaggagtacgctcaacaagactgtgttaagaaatcttactccaaggccttcacgctgacatctctgccctctttgtgacacccaagacgactggggcccgggtggagttaagcgagcagcaactgcagttgtggccgagtgatgctaaccaggatgggtgggatggatgttcacacctggcttttcttagctgcggtcagacctcaccaatctagtagagcctataattcttaccaaggacctgagcagcctagctcctgcatttctcatctctgcctccaattcactt

SEQ ID NO: 90899 - DNA, 329 bp, Homo sapiens
aatgacatgatacgaatcgagctggtacccctggagcccaaagtgctgggattataggcgtgagccaccacacccagcccatctgaggtttttctaatgtagagaatataccatagtgttttaaataacctaccctcttacatttgactgcactcccttcttcaacacacagattgggggcaggagctgctttttcaatgagaagaatgaacagacctagtgggcgttgcctttagacccaggtaagaggaatcccagccttgggacattactttcaagggccaagcccataggccatccttctagaacattctttgggtagctagggc

SEQ ID NO: 90900 - DNA, 470 bp, Homo sapiens
cactcctggttttgttttgttttttgttttgttttacttcagagacagacattttcactgtatacttgcgacttgcaccacaattcaagtctgagattacctaactgatgatgtttattaacacttcagtagaattcttcgcagcagtgaacagtagtgacaggtcattatgtttttcttgctgttttaaatcttcatcttacaatgagttattttgaaattccaaaacatttccctgtattccagaaattgaaaatggttgttcactaaaaagcctcttcttttcctgcttataaatttgccaattttgccattttaaatcacctttcttacgtttctctgaattgtatattatttgtcaatttcacagtttctataatctattgtttgctgaattgttacagtcttttgtttttaatagactagcactattcctaattattaaatctgatttacaaagcattgaatga

SEQ ID NO: 90901 - DNA, 437 bp, Homo sapiens
gaaaaactagaagaacatgcgagactttttttggtactgaaaaaagaatggaatatcaaaacataaaggtaaaggaagcaaatatagaagaaatatttaattgttgccttttaataaatttgcttagatcccaccaatattggatacccaataaaaagttttgtatgaaacaatgaatggcctaaaaccttcagtccagttaactgtgctcagtggatacttactgtcttttgttgaggtgaaccccaaccaaaccatgaggtattgaaacagacaaaagttttttccctaaagaaagcatttaattcaagtattactcatggagtgtctgtggtaccctagaccctagtttaggtgctatcggtcagtgtttctcacaatgtgatgcgaagactaccaccattagaattactaggggatttttgtgttagaaatgt

SEQ ID NO: 90902 - DNA, 281 bp, Homo sapiens
gttttaactaaaagtctgactgccaactgtcttcaccacgcaagaggaatttggcaaatccaccctctctagttcatattatgaaagcaatatgaaatcaccaaatcctattataataatgaatatgcttttcatattataagtgctctgtagagatttttccatcccacctcttggttgtgaatctgcaaatctattaatcttccaaatacagtgatgacatgtttcacaggcgccgagaaggtatattatgggccaaggcaaagttgtagcatatgaca

SEQ ID NO: 90903 - DNA, 841 bp, Homo sapiens
gtctgttgagagggaaccatttccaagatgtatggggaagaatttcctgagctgatgtgagagtgtcattccacagggccatcagacaggagccgagcccctctgccggcagggaaacggtctcttatggaaactgggaatcatatgaagaagaatcctaacctcaaagggtcgtggtgagaatcaaataagaggatgtgcttagcacacaggtgtccaagcagcgagagctccagcatcctgaccccacagcctttgtggttaaccactgctcactgctttccacttgctaggatgccccagaatatttgaatcagagcctccaaatggaaaacggacagtggaagacttctgtacaagtccccagaaaccaggctgaggaagagggagaatccgaagctgacttcagggttttgagcttggctcactggggtgatgaagttgccagtaacaacatggaaatagcaagaagcaggttcaaggggatgtattatcttcatcctggaacgttggattaccgagatgcaagtgggctatctgggtggattttctggcaggtgttggacttccagaaaatgattcttcaaagctacacgaggactaagagtgtgggaaataattgatcccatctgggcaaattcaagtgttttcctgggtgaagacttctgggggcagagagcaaactagaaaacagaaaacagaagtgggtactcatgggtttgtggtcacggcattcagttttcttgcctgcagagtgggtgccttgctttgttcttcccaagctgttgttgaggctgcattaggtcaggaatgggaaattgccctgtagattgtgccctga

SEQ ID NO: 90904 - DNA, 595 bp, Homo sapiens
aaaagcaggggagagcagtaagcatattgatggtgagcttaggtgaaggccagaatattcaactctttatatggtgatggtttgatggacggggtgcttgatgctggttggggagacacataggccaagaggtcagtaaagagattagacaggaataaattgtcccctgcagggaatggaagaaagaagggagcctcagtgctgatttctgctctctctctttcctatgctcttcttctaggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccagacaccccctctaccccctctagagcca

SEQ ID NO: 90905 - DNA, 543 bp, Homo sapiens
  misc_feature (18)..(18): n is a, c, g, or t
agttcgacggagactctncaacatcttttctcaccggggttttccaatctctctcctatagggggaaatgcagtgtgaccctcttgaatgagacagatatcttgagccagtacctggaaaaggaggtgagaaagagatgttgagagaagagcgaggggaatgggtattgcccgcaaaagagagggggaaaggagcacaatgatgaggtacagggttgccagactgccggtcatggaaactcagatacacctccctccctgccgcctatgtggattgctgccttgcttaccttgtctctccccaattccaggactgctttttttactcactggtgtttgaccccgtgcagaagacacttctcgctgatcagggcgagattagagttggttgcaaataccaagctgagatcccagatcgcctagtagagggtaagcaacaggacaagactgtacggctaccaggttgtctaattccaaggggcactttaacattatagtctctgtgaatggcgtcacctggggttgtgcagtgcactgtctgcag

SEQ ID NO: 90906 - DNA, 241 bp, Homo sapiens
tggcatgccagagtttgggaaacacagtctcctccgggtagctggataatacaaagaaaattcgtttttttcagggaccattgtttgatcaagtttcagtataagcgaagcaccccctctgccttttgtacgccagttctcagaaataaagatcttttgtccgtttttttaacctcggattctgtaattggttcttatagtaacaaataaaaagctgttttcttcagcttcacctggctca

SEQ ID NO: 90907 - DNA, 2869 bp, Homo sapiens
agtgggccttgttctccggatcggccgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccccctctgccttttgtacgccagttctcagaaataaagatcttttgtccgtttttttaacctcggattctgtaattggttcttatagtaacaaataaaaagctgttttcttcagcttcacctggctca

SEQ ID NO: 90908 - DNA, 2858 bp, Homo sapiens
agtgggccttgttctccggatcggccgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatcaccactgatcccattgtcctgcaggactga

SEQ ID NO: 90909 - DNA, 3273 bp, Homo sapiens
agtgggccttgttctccggatcggccgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggtgagaaagagatgttgagagaagagcgaggggaatgggtattgcccgcaaaagagagggggaaaggagcacaatgatgaggtacagggttgccagactgccggtcatggaaactcagatacacctccctccctgccgcctatgtggattgctgccttgcttaccttgtctctccccaattccaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttcacctggctca

SEQ ID NO: 90910 - DNA, 3312 bp, Homo sapiens
agtgggccttgttctccggatcggccgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttgtaagtggatggcactaggaggagaagtgggagagatgacaggtgagggaaccaggacctggggccagatgccagctcattcttcctccctctgccccccttagctaccctggaagtcacttgccagcatagtccagttttattacatgtggaaaaccacagaccggtatattcagcaggtattatctgggctggggagggtggaccataggctacctgctgacctctgcctttgaagttgatgacattctccctgctatgaggctctgatccttctctttctttttaccttcttacagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttcacctggctca

SEQ ID NO: 90911 - DNA, 2708 bp, Homo sapiens
  misc_feature (13)..(13): n is a, c, g, or t
  misc_feature (20)..(20): n is a, c, g, or t
  misc_feature (31)..(31): n is a, c, g, or t
  misc_feature (35)..(35): n is a, c, g, or t
cacttgctgcctncaggttnaatgggggggngggncttttcctcccccttggtggggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttcacctggctca

SEQ ID NO: 90912 - DNA, 2321 bp, Homo sapiens
agtgggccttgttctccggatcggccgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggatatttgaaccacaaggaaaagagctatgaccaatcatgaaaatagtcggcgagtctgctcctgacaaccgt

SEQ ID NO: 90913 - DNA, 1660 bp, Homo sapiens
aaaagcaggggagagcagtaagcatattgatggtgagcttaggtgaaggccagaatattcaactctttatatggtgatggtttgatggacggggtgcttgatgctggttggggagacacataggccaagaggtcagtaaagagattagacaggaataaattgtcccctgcagggaatggaagaaagaagggagcctcagtgctgatttctgctctctctctttcctatgctcttcttctaggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttcacctggctca

SEQ ID NO: 90914 - DNA, 2130 bp, Homo sapiens
agtgggccttgttctccggatcggccgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaagacgggtcagctttgtggtctgaagcagaaaagtttgtctgttcttagccagtagcttggccctgttggcgctggttgtgtaaggagagagactttgagcttcaggtctggataactgaccccttgagttgtggccccgtggtcccacctctgggtaaca

SEQ ID NO: 90915 - DNA, 1082 bp, Homo sapiens
tacaatcgagctcgtacccctggctctgaacttaggacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttcacctggctca

SEQ ID NO: 90916 - DNA, 506 bp, Homo sapiens
tcatattcgttcattcattcattggatgtattcaggaaaggctattgagaggttagcaggaactttactattctgtctcttgggggcaaaggaaagggatttggaagtctatccttgaatgtaagtctttactcatattttcttgggctttttaatttaggtccctctgaaacttactgttatttgtctctttgtgcatttctgttcccagatgatcaatttccactgctacgttgttttgtttttgtttttttcctccccttagactgcaaatggaaatgtggaggcaaaggttgtctgtcttttccggcgcagggacatttctagtagcctcaacagcctggctgatagtaatgccagtgagtatcttcctccctttctttttctcctacccatgatctgaggcctgggcatgtccctgcaggtatttcccctggtagcatgcccaaggcagaggtgtgagtttgggggtgggaaatgcctggcctgaggagggaggcctgttt

SEQ ID NO: 90917 - DNA, 3088 bp, Homo sapiens
agtgggccttgttctccggatcggccgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttcacctggctca

SEQ ID NO: 90918 - DNA, 965 bp, Homo sapiens
gcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggcaagaaaaaaaaaaaactccggggttagtggggcggaaaaaggttgaaggcatggcaacggtctcgcccttttgcacgggaatgcggccaagggggtaatgactt

SEQ ID NO: 90919 - DNA, 914 bp, Homo sapiens
  misc_feature (875)..(875): n is a, c, g, or t
  misc_feature (878)..(878): n is a, c, g, or t
gcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggcaagaaaacaaaaanaanaaaaaacaacgcgggccttttcgcggcgggaaaccg

SEQ ID NO: 90920 - DNA, 349 bp, Homo sapiens
gcgggacggggcgaggcggagcgaggctggaggcgcgggagggcagcgagaggttcgcgggtgcagcgcacaggagacctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggcaaga

SEQ ID NO: 90921 - DNA, 848 bp, Homo sapiens
tgctcgtaaccgggttttgggcgaggctggtgcgattcgccgagggtcttgcacatgagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggcaaga

SEQ ID NO: 90922 - DNA, 797 bp, Homo sapiens
gcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctcgctgctgggggcgcaaccaccccttccttaggttgatgtgcttgggaaagctccctccccctccttccccaagagaggaaataaaagccaccttcgccctagggcaaga

SEQ ID NO: 90923 - DNA, 865 bp, Homo sapiens
gcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggcaaga

SEQ ID NO: 90924 - DNA, 903 bp, Homo sapiens
gcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggcaagaaaaaacaacacactcaacaccaacaaacacaaccgggg

SEQ ID NO: 90925 - DNA, 1276 bp, Homo sapiens
gcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggcaagaaaaaaaaaaacacacaaaaaacaaaaaaaaaaatacaaaatcaatatacacaaatacgaaaataacatctaaaataattacacaaaacacaaaacaaaaataaaataaaataaaccacagatatctataatataaaaattaacacagaaaataagaagagagaagaacaagatagagaaagagatagagaacaagggaagaaagtaaaaaggaggagaaaggaggagagagaagcagggggtaagaaaaaaaagacaataagagaaaacaatagaagaaggctacgaagtagagaaagaataagaagaccctcgaatataaagaatcgcgggaaaaaaaacaggagaaaagcaataagaatgaaaagaattaatagaagaagaaaaaaaaggaggataaaaaaaagaatac

SEQ ID NO: 90926 - DNA, 594 bp, Homo sapiens
gagtatctgtctgagtaactctgtctgggagtagactgtcctgggagtagactctgcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggcaaga

SEQ ID NO: 90927 - DNA, 713 bp, Homo sapiens
gcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccactccctccccctccttccccaagagaggaaataaaagccaccttcgccctagggcaaga

SEQ ID NO: 90928 - DNA, 1186 bp, Homo sapiens
  misc_feature (13)..(14): n is a, c, g, or t
agacacttttaanncacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacacatctaaaaaaactcg

SEQ ID NO: 90929 - DNA, 1239 bp, Homo sapiens
  misc_feature (13)..(14): n is a, c, g, or t
agacacttttaanncacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtggacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacacatctaaaaaaactcg

SEQ ID NO: 90930 - DNA, 934 bp, Homo sapiens
ctgacctcaagatccacccgccttggcctcccaaagtgctgggattacaggcatgagccactgcacccggctagactaaaatttttaatggtaatttgtcctcagcaataatagataccttaaataataatgttttaaattttgcgtaagctgtgggaaatcatggagtcttgataatgttttgtttttaaagttttacttatttttaagtaggcagtacattcacatagttcaaaattcaaaaatactaaagactatatatacagtgataatcctgtacccctgccgcccagtaccctgtcccacaggcaaccaattttatcactgaaatcccccccttttaaattacttagttgccttaggtgacaaatccataaatgattatttcggagttctctcagttaacactttatgggttcttggcaaagttctcacaatgttctgtagaaccttgaaatatttttaattacttgggatgggtttaagtattgcttgggataaaggcacttgcaaccccctctaattgtaacattgtgtaggcttaaggacccttattgctgcagacttcatctagccaagatgatgtgagtaagattgatctttttgcttcagctgatggctatcattttttaaaatagcttcagtgttctaattataaaagtatgtcatgcttatttcaaagatcggaaaatacatagaagcataaagaagaaaataaggattagctgtaatcctactgcccagagataaccatagttgtcattttgatgaatatccttccagaccttttcgcgtgcacacacacacacaccacacactttttaaaacagaaaatggaatcatataagtatgtactattttcaagcttatttttcctacttaatatttcatgtcagtatatttagatgtacatcagcatttttaggagttgaag

SEQ ID NO: 90931 - DNA, 2541 bp, Homo sapiens
cttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataa

SEQ ID NO: 90932 - DNA, 855 bp, Homo sapiens
cttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggagaagatcataaccaaccattgtttggagttcagtttaactggcacagtaaagaaggagatccattagtgtttgcaactgtaggaagcaacagagtgagtgttaaggggtctatttagtattt

SEQ ID NO: 90933 - DNA, 824 bp, Homo sapiens
aaatttatttggctcctgtttctggagactgggaagtccaagaacatggtgccggcatctggtgagagccttcatgctgaatcgtctcagcaaaagggcaggagagggtgtgagggagcaagagattgaatttatagcctcaggcccttttataatcagtattaatccatttgtgaggatggagcccccatgacctaaatacctcccattaggccccagctcacaccactattgcattggggattgagtttctagcacatgcttttgggggggcctattcaaactatagcacttacctagctaattctacatctgatgtaaacattttaagttgctatgtaatatggattccatttttaggctttactgtgcataacttacatctagactttagtagtttttctttcacaagatgttgaaagttcacagtaaataaaaaacattcgcctaatttttgtatgtttatactagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaaggtctggtaactgcagttaagc

SEQ ID NO: 90934 - DNA, 2134 bp, Homo sapiens
cttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataa

SEQ ID NO: 90935 - DNA, 2208 bp, Homo sapiens
cttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaattcatgtggggggtggtggcgttggggtggggggtgggtgggtgggggggggggggtcgtgggggtgggtgttgggcggggtgcggtggttggtgtgggggggtgtggtgtggggggggggtgtgggggggtggggggaggggtggggtgggtgggggggtga

SEQ ID NO: 90936 - DNA, 1542 bp, Homo sapiens
atctagaggatccgtatgatctgtgctctctggagagagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataa

SEQ ID NO: 90937 - DNA, 1209 bp, Homo sapiens
  misc_feature (19)..(20): n is a, c, g, or t
  misc_feature (26)..(27): n is a, c, g, or t
tagggaatttggcctcgannacgcannttcaggcacgagcgagaaaaagtaagtaccatgctaacaatgtaaatttgtaaggcccttcataaatttgcacaatgccttcttacttgctcaagacacttgtgatgtattaattgctcttattcatatttacgaatcaggagtataagacccaaagaaatagccaagagcacagaggctggaactgagctttttctgaaacaagaaagctgtctgaggattcctccaatgctttagaacctggtaattttattaatttgatgtttttaaaaatatgtttatacagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataa

SEQ ID NO: 90938 - DNA, 733 bp, Homo sapiens
tattttccagagtggccgtgccattttacattcccaccagcaatgtatgagagatccagtgtctccgaatcttcgccagcatttgtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataa

SEQ ID NO: 90939 - DNA, 503 bp, Homo sapiens
  misc_feature (19)..(19): n is a, c, g, or t
cttgaaccaccgatcgacnccatcgacaggacgcgcgccattgtgttgatacccgccaattcggccattatggccggggtcacagagattatgcccaatttctcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaaggtatcaacatacttttacattttgaaatgatctgacttatgaaagaccattgtaattctagctttttctgttgtgtccatgttctttttcctttacaaatctaccctgatgttttgtattgattactttgccctttgatgtcattcatcaaatactttggtgttattcattctacttttgtggctctgcatatgatctgcagtgcttactttaaattaagttggcagttaggtatcaatggt

SEQ ID NO: 90940 - DNA, 1894 bp, Homo sapiens
cttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgcttcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataa

SEQ ID NO: 90941 - DNA, 820 bp, Homo sapiens
tttgccgaatgcttaccaaacgccagatactgtgcgtgttgtatcatttaatcttccccatctctgtgagggtagacgttatctccactttgcagatcagaaaagtgggactcagagaaatgagaccctttcccaagcagctcagacaggaaggtgttgtgggcaggtcttcccaggtcttacccagcagtactcactagcgctccgtctgttctgagcccctccttcctggtcctatgaaggtctctctcctctcagtagcaggccccacattcagctcacttgctctgtctcctgccatctgcttcacagctcaagacccctgggccccctgcttagcttaaccctggtctgtccctttctgacttggcccgtgagatgtctatgttctctttccctccatccagggaaggagcaaaagccccttgccatccctgtgtgacagcaatgaggtgaacccaggggccgaagcccacccagggagttgatggtaagactcaccttcgttttccttcccctcctcagaagtgtggctccttcctctgcattcactgggtgatgctggggtctgtaggctgagaggagcaggagatccagtggcaaggaagacgaaaacacagagcaggccaggcacgtatttttggattagttttagagaacaagttctaagctgtgctttttatgttgcctttagaaaatgttaaaatactttctaggctgggtgcagtggcttgcgcctgaggcagacgggtcacttaagcccaggagtttgagaccatcctgagtaacatatggggagaccctgtctctacaaaaagta

SEQ ID NO: 90942 - DNA, 388 bp, Homo sapiens
agctcgcagttttagaagtcagaagagccataatttccccccttgtatctgcccccggaggagtttacccgtctgccccggggaagggaaaaaagggagacaccttgttgagccaccctactgtgtacctggcactttaaaacccctgagccctcatcaagatgggattaatatcctcagtttaatcaatggggaaactgaagccttagacaagacaagtaattctctccagttagtggccactccaatatctgagcctcaaatttttttttatagtagagaacatgtaggcattaaatatttgactacatagaaagagacagagatgagaaagagagaaagtgaaagagatacatacacggtgaaaaaataaatagacaaaaataaa

SEQ ID NO: 90943 - DNA, 141 bp, Homo sapiens
ccagaggcaacagattaaacatatttattaaaattttttgaaattctagttccaacgaactgcataataatatatacaccgtgtatcctgtttccgtgagatgcacgtaaagctaggataaataaaaataattttttgatc

SEQ ID NO: 90944 - DNA, 386 bp, Homo sapiens
aaaatatgtaaattcactttcagtatcttttacccaaagaatcattctatacttctgcacaaggtgagaataaaaaaggttactttataaaatgactgtaaaaatagtgagtacaaatattcttttggtcgttatgatgctgtaacattctctgctggtttcaacaatattccttttttttagtcttcctgtttgtctttggacttccaaacagtgagtttaaatatcatagcaacagtgaaccaggttttgtactatttgatttattttttaatctatcttatttgccgtataaaattattaatcttcatcttttaacttacatatcttttctccagcctagcattatatattgagaggaaatccactaaaagtagatcacaaaa

SEQ ID NO: 90945 - DNA, 482 bp, Homo sapiens
  misc_feature (431)..(431): n is a, c, g, or t
  misc_feature (450)..(450): n is a, c, g, or t
  misc_feature (475)..(475): n is a, c, g, or t
  misc_feature (477)..(478): n is a, c, g, or t
  misc_feature (482)..(482): n is a, c, g, or t
aatacatttgacattgtcatttttccaactaatttgaattagaaataataattgaccttatgaattatgtgcatgggatggtttataggggtttgaaagaggcagacacttgctacaggttttaaaaatcatcagggttaagtataagaagcattatatctgggaagtacagggaaaggcaattgcattatttttcttaatttgcttttctaggtaagcaatatgtacttattaagattttatttaaacaattgaaatggggagctgcagaagaacattattgtttctttctattcttccttgatgccctcccctcccctccccttcccttcccttccctttccttcccttcacttcccttcccttcccttcccttcccttcgcttccctccccttccgacagaacatcactctgttgcccaggctgagantcgtgccactgcactatancctgggcaacagagcaagactccananngatn

SEQ ID NO: 90946 - DNA, 357 bp, Homo sapiens
ggtagatatcagaggagccagaaggagccctgatttccttgcaaaagttagacttcagcttgcatttgctgcttctggtaacggggaaaatgacagggagcgacccggggttttatgtctggcaataatgtttgatctatgccattgtcgatgagaactgcgatttaatccataaggatatagagcctcgtgatgaaaggggaataacgacaaatcctgattaacaatcgctgcgacactaaagcaggttaccatagtaacggggctgaaattatacaacaaactgggatgccataccaggcaaattactccgtgaagggacccttttctgaaagcatttggctttctgtgttctct

SEQ ID NO: 90947 - DNA, 323 bp, Homo sapiens
agggtttgtggagatgcaccgtgtatcacatatgtctgtgcaaaaccattcgtgttaggatcctaaaactatcatcagtggaaacactggcagttttagtgagctggtcacatttcatgaatgcaagatgttagacttctatagcagggtgtgtgtcatctagagcaagttattgactgtacaggtatttgagctccaccagaattccctagaggaaagaaagtgtgttcctcattgaacataatggaaatagtaagacgttcaggcagtctggtctgcagcattcgaatgtttcttgcatctcaaacttcttaagactgtga

SEQ ID NO: 90948 - DNA, 1150 bp, Homo sapiens
ctcacttatcattctgggtaatgaccaggcctagataaagacctcatataagtggaattatgtagtatttgtctttctgtgactggcttattttacttagcataatgtcttcaaggttcatccatgttgtcaccatatttccttcttctctgaggccaaatagtattccatttatgtatttactacattttctttattcattcatctgtcaatggatatttaggttgtttccacatcttggctgttgtgatatctattaattgttaagctggtctctgtattgaaatctccttgcctatatttctccatagtttaacatcctgcaaggaccagagcagattttgtctgttgttttttggttttggttgttgttattgttagagacagtgtctcattctgttgtccaggctgtagtgcagtggtgcagtcatggctcactgctcactgtaacctcaaatgcctggactcaagtgatccctcatctcagcctccggagtagctgagactgcaggcacacactatcacacttggcgaatttttctgtttttttgtaacagcctgttgcccaggctgatctcaaactcctgggctgaagcaatctgcccacctcggcctcctgaagtgctgggtttacaggcgtgagcccccgcatctagcttgcacctcatttattaagggttcgttatgagccaggcactctttaaggtctttggactatatagttactgaaataagacacagtcccagtactccaagaacttagtctgtttgaggacatggaaattttaattcattgctcttacagagtgagtatggaaattgaagtgtatcccaaactttctggtagcatataggaaagggatgatttctcagtttgatgtaaacctcattcaagtgccacttcttacatgcaggctatcctggtcactacccagtctgatttgtgtttttatactctcctttactcagttctctttcttttccagcccccaaatcatcagcatttcctatgactcaacacttagcttttcattcattcttctagatccttttctttaggaaatggatttaatttcaagggttcagctgaaactttcaaatttgtagtagctccaacaaaacattttattgtgaagtaatacacatacaa

SEQ ID NO: 90949 - DNA, 310 bp, Homo sapiens
tgtttccctttgtctgccaggacactgagatttggagagtctcttcaccctctgaaaacaagaggatgtgtagcatagtgagcaacagctgtgtgccggggactcagcattaagtagcatgggattactcatgacttcgcactcatggcagcctcacagagtctcactctgtggtccaggctgaagtacagtggcatgatcccaggtcactgcaacccccacctcccgggttcaagtgatcctcctgcctcagcctcccgagtagctggtattacaggcgtgtgccacaaagcctggctaagttttgtat

SEQ ID NO: 90950 - DNA, 802 bp, Homo sapiens
tgtttccctttgtctgccaggacactgagatttggagagtctcttcaccctctgaaaacaagaggatgtgtagcatagtgagcaacagctgtgtgccggggactcagcattaagtagcatgggattactcatgacttcgcactcatggcagcctcacaggtaactttgtcaatttctttttttccttttatattaaaaaaacaaaatggctgggttcagtggctcatgcctgtgatctcagcactttgggaggcaggggagggaggatggcttgagctcaagagttccagaccagcctgggcaacacagtgagactctgcctctacaaaaataattaattaattaattaattaattaataaaataaatgaatcaattaaaagaattaagaaaaacaaaacaaaactttttgaataagtaaagcatttacaagacacaaaatccaaaaggtatacaaagttttccaatgaagactgccaaccctcatgtccccagacccctgtttctcctccctgggacacagttgttgcaggtttcttgctccttcttcctgaaagagtctgtgcattattgaaaagaagatgtgtgtccatgagtacatctacagacgagtgttgagcacctgttgtgcacagtggtgggggcagtgtgatgggagtacacagggcagggagacacgggtctgggctcccctgaagtttgcagccgtattaagggctcggccttacagtgcgtggggcctcggcttcagaggaagggctgatcttggggctggctgctgcttgacttggagtacctgcctc

SEQ ID NO: 90951 - DNA, 458 bp, Homo sapiens
gaaaaacacagaggctaatgctcatttatatgataattctatagtggaatgtagggtggatttctttttcatttggtgccatttatttagaagatacaaaataaatgatttttagatgcatcctcagagtactgataaaagatcaatacttcttaaattaatgttcttactgcattatgcaaaaatttgttttaaaatcctcaggattttatgatcacaccttcatgtactgatgcttaatgggaaaatattaaattttccctattaaatactacattccaaattctaaattcttgcagctttgccaagttcaaataagtatagtaaatttaactttggaatttcctgacttttgcattgctgaaattttagattttgcccaacattaagggagtctttcaatttaaattccctttatttaaaatgtttagggcaattgtgaaaagtgaggaaattgg

SEQ ID NO: 90952 - DNA, 379 bp, Homo sapiens
gtttttgctaattttatacattggtttttagaagtctcttatactgaataaatttacattttacatagtctatattactcacattatttttaaagatttattttttacattaactgtttagtaaacagaataggtgtggaataaattctgtagtgtttctacttcgattacataaagaaacatgataacttttaccttctattacccatctgtttttacaacattcaaattgtaactatatattcagatattatttcagggcattaataggaaaaaaacaaaattgtccgacccaaacagaatctctcttctgttaaattaggggatccatagctatgctctttcttacagtaataaaatggtgaaaatattctaaact

SEQ ID NO: 90953 - DNA, 180 bp, Homo sapiens
gagtgagaatatgaccctgtctcaaaaaatgaaaaagaaaaaaagaagacacggggattgggtctaggtaatttagtgtatgtagactcatttaagtatttgccagagtatgagtactttgtttctttgtttttcatggtctgaaaccctgttaagcttttttttttttttttttttttt

SEQ ID NO: 90954 - DNA, 940 bp, Homo sapiens
tgcccttaattatataccaaagtaagaaaaataattcagataagaaagtcttaaagacttctatctctttaagtgcctcatactataatctctattttatttctaggcttccatgtgtcaaactaccttgcctacacaaacgaaccataataataaatatcacagaacacataaaatctttagagtttacagattgatacatattcataattttatttgataatttctttagttctatgtaaaagacaggaatacttctgctttttctattatacagttggagacactaacaaagagaagagccaagggtttgctcagagtatctgtaagcgttagatattctgagtgtgactatcagccagagctgttcacataaacatggtaatctaagctctgaacttctttggaagtaaattattgtctgtgacagaaagaaagagcagcatatttctttttatttaattatgaggttctggagggtttctgtgaattcaagagatgggaaagtcattatttttatttcattctctttcatgtctccactacagatgttgccatatgtttttcttttgtttgttatgtttttatggtttgcctctcaaatttacagacaccatctacagttggggttagaaaaaatgctcaaatctcagctgggcgcggtggctcacacctgtaatcccagcactttgggaggccgaggcaggaggatcacctgaggtcgggagttcgagactagcctgaccaacatggaaaaaccctgtctttactaaaaatacaaaaaattaactgggcgtggtgttgcatgcctgtaatcccagctactcgggaggctgaagcaggagaatcacttgcacctgggaggcagaggttgcggtgagccaaggtcacgacattgcactccaccagcctggccaacaagagcaaaattctgtctcaa

SEQ ID NO: 90955 - DNA, 247 bp, Homo sapiens
cagccacagggcatgtcttgaagggacagccaagtatagggacaaagcaggagcccaggaccaaagcaggtgtccagatggaattagatgtctgctatggaatgcatgttggagattaggtgaagccctaccaccaaataccatcatattgggaattagggctttaacatagaaatttacagtgggggacacaaacattcatccaataacagtaattattgatattattggatttatatctatcatt

SEQ ID NO: 90956 - DNA, 344 bp, Homo sapiens
acaaggggataggagggtatattgtcatatgatctagcgtctctctgagcttttacaattctaagcatctaaaagcattacataaattgaaacaaaatcataaagcatatacttgttaaatctctagatgagacaaaactgaaagagtaacagtaaagagtgaaaacgaattcagactatataggaataggctaaaatcactattatgaaattaaacaggaagaaacaaagacctgaatttagatttaacaaaaaaactacacaaatacagaacagagcagacttggtttgacaatgattcatttgaaaacgagctaggttttttagcatatgctcccagggcc

SEQ ID NO: 90957 - DNA, 712 bp, Homo sapiens
ttctaaagcaccaacacagaggtgatcaaaatactctaagaagcactgggaaacattgaggggatggttcaaacatcagagctaaggcctaatttcccaacagtcattatttctgtggtattttgcatattagagacgtataggttcctcacctaatccttgttttttcattttatttttaatacatatgaaagtcataataacaaaaaaaattcatacatcagcagctcagctagaaataaaagtctcaatctactggaagcccctgtgaacttgtatcaaattcctttctctcttcatagaggaaataatgactcccaaaatgtggtaatgaacaaatatctctaattgtttaaaatttagtatatgtgcaagtctccacagacacaatcatgatcatatatttttagaagttaaaaacgtgtctatcatcagggcgtggtggttcatgcctgtaatcccagcactttgggaggcctaagtgggtggatcacctgaggtcaggcgttcaagaccagcctggccgacatggtgaaaccctgtctctactaaaaatacaaaagttagccaggcgtggtggagggtgcctgtaatccgagctactcaggaggctgaggcaggagaattgcttgaacccgggaggcggaggttgcggtgagccaagaccacgccactgcactccagcctggacaacagagcaaaaactccgact

SEQ ID NO: 90958 - DNA, 108 bp, Homo sapiens
agtttattattcctttatcccagtataattttgcatagtcatcactctctttgttatgggtatctatacttaaagaataaatatatatgagttatctacacatgagct

SEQ ID NO: 90959 - DNA, 159 bp, Homo sapiens
gatggatataatggatgaaaaggtggatataatggatagatgtatgcatggatagatggatggatgtttaaaaggagatgaaaaaggcactagttgtctgcatcgttcccatctggttcaatatccctttccattaaatttattttttatttttatttt

SEQ ID NO: 90960 - DNA, 471 bp, Homo sapiens
taaggtgactctagcaggatgctttaaggcgagccgggtggtggggaaagagaacagaaaggaagggccagatggcccaagcactgagtaacagccacccacgtccacaactgccaacacgcagagggagaagctgagagcctggaactggtgacgaaagcggggaccccactcccggagcttcatagccacactggcaatgcaaactggattagaaactcattccaccactaaggaaggctggcaccaataaaaccacaccaccagggtgatgtgcgagatttgagaccagccgtaagaaacaagaggaactggggccagagtctgaagactgcccagtaaaacagatacattgaaaagctgatgaaaactcaggggagaaagccacaggcaggagccttccagaaccagcatctatttctctcacacctgctaatcacaggcacaggacacacttcaccaggatgtttg

SEQ ID NO: 90961 - DNA, 458 bp, Homo sapiens
ccagtccctgaaggtcccctgacctcccaattttgatggacagtaagaagaggttcccaggccgactgccacaggttctgactcggcctgggttagggtaagtctccgggctgctgtcctcaaaagccccatcaggaggctgtgtcaggccaggcgcaccgtggtgacagcagcatggactgagggttctggccgcgggagaggcaggacggggggaggtcaggtccaggaggagggcactggccggcacatggtggggctggagagaccctggccgggttggtgggaatggcccaggaggagctccggctcctgtggctggagtgagggtgtgggctgtggtgggagagggggtgaaggtggagagaacaggggcccagaggtctgtgctgtaggaagggtatggacttcctagtgaggactttctggtggggggctctcagagaagaggaggccgg

SEQ ID NO: 90962 - DNA, 553 bp, Homo sapiens
agtggacaaatctgcagagtacagatgtctgcattaggagtgcagtgtgataccattttttttctttcttcactcaaatctgtggagttgtcccccacatttactctgcattctctgttaaaatattttgtggaaatatattctgggggaacactggtaactgcacatctttccacaagtgtcttttatagtataaaccaaaacatggatgccatgactttgtcttttagaagggagtttcttggcatccttgcttagaactcacccttgaaaagatgttaacgctaatctttaaatttcaacaaggtgtgtagtttgactctaaaaggggaatgaagtagctcagaatgcttaaatctttagagagcaacccaaagtcaaaggcattataagctgtggttcagctaatttacaaggaggataattgcagaaaaattatcatataagtttactggaaataaccactaaattctttaacttactgtgagtatagcctaagatacctgctttagttatttactgctatttgacaaactgctgcaaaacagtggct

SEQ ID NO: 90963 - DNA, 373 bp, Homo sapiens
gctttcttattctttggcgcggaggccttccgttgggtcccactgcctgctgtcttatctccttctaatgaatatgatcatgatttttctgtatttagacaactccacgatgaggaggatgatggcggcagctaacatttatgtatgtatgtatgtatgtatgtatttagagacagattctctgtcacccaggtgcagtggtgcaatcttggctcactgcaacctccccctcctggattcaagtgattctcatgcctcagctacttgggaggctgaggtgagaggatgacctgagcccaggaggttgaggctgcagtgagccatggtgacaccgctgcaatccagcctgggtgacagtgatatcctgtcttaa

SEQ ID NO: 90964 - DNA, 1007 bp, Homo sapiens
gctttcttattctttggcgcggaggccttccgttgggtcccactgcctgctgtcttatctccttctaatgaatatgatcatgatttttctgtatttagacaactccacgatgaggaggatgatggcggcagctaacatttatgtatgtatgtatgtatgtatgtatttagagacagattctctgtcacccaggtgcagtggtgcaatcttggctcactgcaacctccccctcctggattcaagtgattctcatgcctcagctccccgagtagctgggactacagatgcacaccaccacacccagctaatttttgtatttttagtagagacgagattttaccatgttgtccaggctggtccggaattcctgacctcaagtgatctgcccaccccggccttccaaagtgctgagattacaggcgcctgcctccacacccagccagcagctaacatttattaagtgctcactatactcctgccaagcactattataatttgtcttctaacaggctttttataagggaagtgctactattatacccattacatagatggtaaaactgaggcacagagaggctatgtaagtttcccaaagtcatgtactaattgatgaagacccagggtttgagctctgcaggaatggccgactccttgtggtttgagcctgggctccctctccatctgtcttttctccctgagccctcctgactgcagccatgccagactttttaatgttcggaaccccagctccagcctatcactggagctctgcctgtgatctttccacctcatgcctcccggttctatgtgtgccttcagactccatctggcagtggtatctggatggaccagtgcatagaaatcacatgagacactcaataaatgtagactcctagtgattctgactagcaggtctggggtggggccaggtacccagatttgcacgggaagtcagggaccactgctgctgactgcttttttcctgggtgcttggcacactctgtcac

SEQ ID NO: 90965 - DNA, 439 bp, Homo sapiens
gaggaccaacatatgagggtagagagagcctttctctttcagggcaacatttttccctggccacctgggcctctcaatgaagatagtgtgttcagggacttgtagagtgtagtttagtaggaccatagcatagaatgggtaagtgacagtagcaagagctgtgagatgtgacttttgttttgggatagacatccttcaggataattgagagtgttattggtggaaaattagaactcttactttgttaagcattttaaaataccagcgataaaaactgtaatcacaatttgttttgagtttaagcccaggatgtagactgggtatttttaatgtcatcaagggaatagggcagagggttattcccaggcacataactgtgaaaacaaatgataacgtgggccgagtgtgggggctcacgcctgtaatcccaacacttggg

SEQ ID NO: 90966 - DNA, 163 bp, Homo sapiens
tcttaatcttacctctgttccactcaagatacctggagttcacttcaattccttggtctcctgtttcttccacacgctgtcagccaggcaagtcatcctttgtggtatctcttgcatccttcgagatgtctcttgcgtctatttcatctttttatatccagta

SEQ ID NO: 90967 - DNA, 267 bp, Homo sapiens
ttaatcaggctgctgcaaatgcttggccaaaagcaataagggcatgactgagagactgtgggagtttaatataaaaaatttaataaacaaaaaagtgggggaaggagaaagggtctaccttttaatagggccctaattacccaactcataggatcagcccaaatgagatgggagtttatttcgggggtttttttaattattattttatatatatatataaattgccgctatgtgttttctttcctctgagcaattatgcagcaagta

SEQ ID NO: 90968 - DNA, 1233 bp, Homo sapiens
gagcctcccaaaggaacatgacttgctaacaggccagggttgattttagcctagtgagactcattttggacttttgacatccagaactttaaaatacatctgtgtgtctgccattatttgttacagcaacaacacgaagccagtaccgtcacatgccagtaaatacaggagctgagatgagaaccctggtgcagagctcactcactccacccttactctgttttctctgcagctcctctgctctactgaggtgcagcaggtgatatgatatggtgattccctcttggctttgcctgtgatactgctttaaatgtaatgtttttccctgcctaatgtctgccttcctaatttttcaaggcctaggggaagttctatggattaataactcttgactatctagcatgacgtccggcacactggacgtcctgtgattttcatcaccccagcttctttcttggagctgctgttgcactaatagacaataggccatgtcttccgcttagcagcctgtcttggtttctagttttccctgggctttagtggtatcttcctaacaataagcatagatagacaggggccaatgagtcctgaagtcattttattttatttaatgtttatttatttatttgacagggtctcactctgttgcccaagctagagtgcagtggcacagtcacggctcattgcagcttcaaactcccgaggctcaggtgatcttcctgcaggctcacgccatcacacccagttaatttttgtagagatgaggttttgccatgttgcctaggctgctcttgaattcctgggctcaagcagtccacccaccttggcctcccaaagtgctgggattacaggcatgagccactgcgcctggctctagtcattttaatagcaagtatcctggtataatcatgtcccagcggccttttctcactggccttcaggtttcaggttccccatctgttaaataagggagctttgccctagttatctgtaagggacacttcatcttgaaaatgcaaatggccttggcctatttttgtaggcctgggagctaaggatgttttttacatttttaaagcattgtttggaggggaaaaagagaacatgtgacagagacctcatctagctgactcctgtgttagaccttaagaacagcctgaaatggggtggaggaggtttctcagtggatatatttagtttgcagagtccttccttcccctgagggctaccaaa

SEQ ID NO: 90969 - DNA, 424 bp, Homo sapiens
ctttgcattccgatattcattccttggcctcccctttattaaaaacaaccctctcccttagatcttgcatttgccactaggtattgttgtgtcatttcccttccctttaacccataatccttgtcagagccaaataatctgctttctctatcttttgtggcttcattctctagaacctccgtaccctaccattatctttttttctaactttgtcatcttgctgaattagtttttgccaaggttacaaataacctaatggccaaattcactgacagtatctcaatcccaatctcatttgaatgctccctgatgggtgcagtggcttatacctgtaattccagcactttgggaggccaaggcagcagtatcacttgaggctaggatttcaaaactggctagtcaacatagtgagacctcgtcttta

SEQ ID NO: 90970 - DNA, 657 bp, Homo sapiens
aaggaaacaaaactgtaagtttcccttacatatgaaacccaactaaacaatatttagatcaaatacactgacctgcctcctatgtagatcagctagcctctgaggggcaaaaccacactgcttggttatggagactgcaagaccttccagggcctgcagctcaggagaagtaggggccctgggcagctgtgtttatttgcagagccaccaaactcactaccccatatcataatcttccaaaccagcctgagcataactagcttccttacatctttactaagaaaaggaaaggcttctttcttagttttttgttatcagggaggaatggtttaggtggcaaataatgaaaaaaaccaaagtagatactagtttaaacacacagggaacttttttttattgcttaatgaaaaactggagacagcccagggctggtgcagccagtgtggtatcaacataccaggcaccttttgccttcctgtgttgctatccttagcccattggtttcctaccttatggccacaagatagctgctgcagctccagatctaccagctaccttcaaggcagcagaaaaggagaaaaaaatggagtctgacccttttaaaaatgtgaataaaatatttcccaggacctctcaccactatacttcaaaagactt

SEQ ID NO: 90971 - DNA, 332 bp, Homo sapiens
tgtttaatccttaaaatggctctctggtatacatggtgatatctatacattacagataaggaaactgaggctcagggttagtacagtgtcatataattaataagtagagtcagaacttgaaactaacactgccttccaagtgcttagttgttttgccatactggcactaattagtaatcagcgaggttgtgaacatgttctccctattcttctgctccccacccccacccttcacatgagctgcttttccttgtcagctgactggccctcaggtgttctggggctaagagaagctccagtacagataaggcctgttggccttctgccttctc

SEQ ID NO: 90972 - DNA, 358 bp, Homo sapiens
gtctcaaaaaaaaaaagaaaaaaaaaaaaggctttatgggactatattggtgaactctagagcatccagtgaggggctgtgggatgagtgaaagctaatttctaagaatcacgaggtgtgctctgaggacaaagaggaaaccttagggaagtggcaccaagtgaaaccagaaaggagactgggatcatattgtggttgaccttaaatattaccttagtgttgaggagtcacctgtgtaactgaggagagaggaggaggtgtgcatgactccagcaggttggaaaaagccagtgcctctgccagacaggaatgtggaacgggtggaaagtggtgtgatcttagatgtgtagagtgtgat

SEQ ID NO: 90973 - DNA, 2425 bp, Homo sapiens
gctggttactgcatttctccatgtggcagacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggaccattcaaagactgtcagcaagcaaaagaagctgggcattcggtcagtgggatttatatgattaaacctgaaaacagcaatggaccaatgcagttatggtgtgaaaacagtttggaccctgggggttggactgttattcagaaaagaacagacggctctgtcaacttcttcagaaattgggaaaattataagaaagggtttggaaacattgacggagaatactggcttggactggaaaatatctatatgcttagcaatcaagataattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacataaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattga

SEQ ID NO: 90974 - DNA, 2552 bp, Homo sapiens
gctggttactgcatttctccatgtggcagacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggaccattcaaagactgtcagcaagcaaaagaagctgggcattcggtcagtgggatttatatgattaaacctgaaaacagcaatggaccaatgcagttatggtgtgaaaacagtttggaccctgggggttggactgttattcagaaaagaacagacggctctgtcaacttcttcagaaattgggaaaattataagaaagggtttggaaacattgacggagaatactggcttggactggaaaatatctatatgcttagcaatcaagataattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacataaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattgaatttgtgcctttcacacgtaatgattaaatctgaattcttaataatatatcctatgctgattttcccaaaacatgacccatagtattaaatacatatcatttttaaaaataaaaaaaaacccaaaaa

SEQ ID NO: 90975 - DNA, 730 bp, Homo sapiens
ggtcttgttttaattagaattattaagaggaaattaaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacataaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattga

SEQ ID NO: 90976 - DNA, 685 bp, Homo sapiens
gaaacctgcctctcttcagtcaataggcttgatcatcatctgaactgctctaaaggagtatgactcgccaatttaaatgacacagaactttgtacttttcagctcttaaaaatgtaaatgttacatgtatattacttggcacaatttatttctacacataaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattgaatttgtgcctttcacacgtaatgattaaatctgaattcttaataatatatcctatgctgattttcccaaaacatgacccatagtattaaatacatatcatttttaaaaataaaaaaaaacccaaaaa

SEQ ID NO: 90977 - DNA, 1282 bp, Homo sapiens
aacaccttcttgtgcctctggttcgcatttatccgtcccaccaattgaaaaaccaatcatgtttggtttctttgcaaatcaaaattctttaagaaatgatacctcttctcccctgacaaatgaaggaccattcaaagactgtcagcaagcaaaagaagctgggcattcggtcagtgggatttatatgattaaacctgaaaacagcaatggaccaatgcagttatggtgtgaaaacagtttggaccctgggggttggactgttattcagaaaagaacagacggctctgtcaacttcttcagaaattgggaaaattataagaaagggtttggaaacattgacggagaatactggcttggactggaaaatatctatatgcttagcaatcaagataattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacataaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattga

SEQ ID NO: 90978 - DNA, 1404 bp, Homo sapiens
gctggttactgcatttctccatgtggcagacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggtgagttacctcttactgtaaaaagtgggagtatgaggtttatatttttatgccttatgaaacaatgctcataataaatgcttattcattttgcgatgttatatatgtacattaaaatttctattgttttttatta

SEQ ID NO: 90979 - DNA, 275 bp, Homo sapiens
gctgtcacattggaaggctataaagttagtgcaattatcctgtcattacctaaaaaaaggataggcaaactgcagactgtgggccaaatacccacaaactgctcctgtaaataaaattattggaacacatctaaactcactcatttaagtattgtctacagctgctttcttgtgacagcagtgttgattagttgtgcgagaatccatatgatccacaaagcctaaaatatttatcatctaaatatatacagaaaaagtttaccaatccctggcct

SEQ ID NO: 90980 - DNA, 405 bp, Homo sapiens
tcttcattcagcatagtaggccccaaatttgaaatgagaaagtacaacttttcctgttacttttccagttagaggcttctcttactagagactgcagtcaggtacttggattctgaaatggagttaatgtgacaactgctttggaatctcagtgctttggtactggatttaaagtaacttacagttgaaactgatttccaactgcaagaggtgacacaaaccctgacttttttggaaaatgttttaaatataaaacctgaagtgaaaaaggcttctaaggtaaaaaagattttaaaatatggtaagtgctttaaattagtaagtcggttttttaggtgggtgattcaactgctttctagttagtctggtcattttttattccagagatttcttaatatgtctact

SEQ ID NO: 90981 - DNA, 546 bp, Homo sapiens
ggtgtgatggtgcctgcctgtaatcctagctacttgggaggccgaggcaggaggattgcttgagctggggaggttgagtcttcaatgaactgtgattgtgctactgtactccagcctggtgaccgaaatgagtctctgtctcaaaaaagagtatacttggccaggcgcagtggctcacacctgtaatcccaacactctggggggccgaggcaggaggactgcttgagcccagaagttcaagaccagcctgcgcaacatggtaaaaccctgtctctacaaaaaaattaaaaagccaggtgtggtgttgtgtgcctgcagtccccgctacttgggagactgaggtgggagactcacccaaagcctggagattaaggctgcggtgagccaagatcacgctactgcactctagccggggcatcggcagtatccttatgactttttgtaatcccttcttttgctccttactaccctctctgtatccctaggaaaccattgtttcctttctgttgcttaagattagtttttattttctagaattttataaaa

SEQ ID NO: 90982 - DNA, 355 bp, Homo sapiens
tgagtcagggtctcactctgtcgcacaggctggagtgcagctgagcaagactctgtgtctctcaaataataataataatgatgttcgtaagacttgaactaatatcacagtcaattttttaaaatccagacttcgctaaaacctagactgagaatttatgcatcaatggtacaaataaatgaagttttaataatccaaagcaactcatattttccaaattatattaaaaacaataatggatgtttaagtatttcacatcacttacatctaaccaatgagccaaataaaataatgttttctacttaaactttgactttaaactattaaagggctgggcacagtggctcatgcctgt

SEQ ID NO: 90983 - DNA, 507 bp, Homo sapiens
agagtgtggggtggagctggggggtgccagacctggtcacggttaggggcctcttcccagcctcctcccggtttcccatctcacccgttcaggaccaaggcttttgacactcagctaacgtgggcaacttctcagagaactggggggagaggcatgcaggttaatcacaaagagatgcactctgtcctaacaaggtcatctgcacacccacgcatttaaccacaggacaaaggcactatgtgaaatgaaaaaaaaaaaaaaagatgacctggcactgcagcacaggaggcaggcgtccagaagcttgctcacaccctgcttagcccctgacttcagtctcccaggcctcagagaactagaaagaagccctatggtcagtctgccagcagaggagggttgctttctgagtccagccaccaccttggccatccctggggcctgaggactgccaggggaggaatggagagaggccaagggcagcctggaagttgacagagaggaatgcag

SEQ ID NO: 90984 - DNA, 305 bp, Homo sapiens
acaggcatgtaggctaatttttgtattagtagagacagggggtttcaccatgtaggccaggctgggctcgaactcctgagctcaggtgatccaccagccttggcctcccaaagtgttgggattgcaggtgtgagccaccgcgcctagccgagtgacagttttaaatacagatgtctcacaccaaagctaatatactcttcactctaaaatgattagggttatgttaaggggatgaaaaaaatgctgctcagtgctattaggaaggagcttatgtaagatgctatggactatttaaaattaattta

SEQ ID NO: 90985 - DNA, 441 bp, Homo sapiens
  misc_feature (19)..(19): n is a, c, g, or t
ttttttttgaaggtcgganagcatctttattgtggggagggagagcatcaggaaaaatagctaatgcatgccgggcttaatacctaagtgatgggttgataggtgcagcaaaccaccatggtacacgtttacctatgtaacaaacctgcacatcctgcacatgtactctggaacttaaataaatttttttttaaaaaaagaaatgcagatggataggagaatgattggttctgcctgaaagatgaggtaagtcttctcaaaaaagttaatatttcatcaaggctatgtcttttcgtgagttttattatacaatattcataacaatcctgtgaaatagatcttattcccatttttataatgaagatatcttaatttctgacaagcaacttgtccaaagttaatacatccatgaaatgcctagaatggctgtgcgatgctgaa

SEQ ID NO: 90986 - DNA, 528 bp, Homo sapiens
cagtagactaagtaggtaagaaaaaattatggtagagaaacttatgaaaaatccatctattaattttctttcctgtgaattagaaaaataccattgttcttttccagccaaaagaatatctccctctaggagccattaaatattttgaaaaggagtgacatggtgtggaatgtgttttaggagtcaggtggtagtgacatgtaggattagaggactggcaatgagtcagtaatgtggtgcagtggtccagatgtggtgaggatctgaaccttagtagcagcagcagtgaaaatagaatgaaaggaaatagagatccacaccaggccctctgtttctaaataggaaatagttaccaattattaaccagctttcatattgttaggatattacgggtctcaatggtcggttatctctggtctcaagtcctttcactctatttttagggaaaatgtgtttaaacccctattttaaggaaatgatagtttatagattatttataaattatagttaatttagaaaatagaaaaa

SEQ ID NO: 90987 - DNA, 268 bp, Homo sapiens
gccacggggatctgtggcccaggcccgtgcccccgggaggttaggaaaggaccgtctctcctgtctgagaccatgcccaaagcaggtttttgcttgggccaattttctactttagtcatggggcatttcagggttaaaatgccaccatctcatttaacccactccagaccttcattttctcacacgaaggtgatctgtgcaaggaagaggagattgcgcggatcgcccggaggctggacaagatggtgaccaagaagagcgcttcggg

SEQ ID NO: 90988 - DNA, 395 bp, Homo sapiens
atagttatttcccacatcccaaactggggcacaaatgatttgttttaatttaggaattgtgtgggaaatcttacaaaaggctcatgcagaagatgatataagctttttatctccagccagagtctctcccctgaactccagattcacatatccagctgcacctatatttggatgtctaatagatgtctcagacttcaaaagtttgaacccctgatctccgcctttgactctgcctcccttgtctgctttcttggcagtctttccatcttggttaatggcatccccataattccaggtgcgtggggacaaaatctctccttctttcagatctccttctctcctctcagtgcaccccgttggcttttcctccaagctatgcatgttcatgatccagc

SEQ ID NO: 90989 - DNA, 496 bp, Homo sapiens
tcccctcaaagagcttacagtcaaactgggaagaagatcagtagcaatcagatctacaatgagagtggagggtaattggtatagatatttactatgcaattttattcaacaaacatttattaaactctcactacacgcagggcagtatgttaggtgctggggatacaacaatgagttagacatagtccctgccctcagggatgtcacagtctagtgggagtggggggcatgagtcatagaaacagccaatataaacccattattcctgcctgaccctcccatgccaatccaaggaaaaagatatggtgaggccctctcagataggcagcagcttagagaagctcagccatctacaattagggacaacatccacctcaggtctggacacagaggatactccatagtagccttaatcccatattgatcccaacctcaaagtaatttccccagattttgccctaacagggtgtctgttcctagatcctttagggtgtga

SEQ ID NO: 90990 - DNA, 862 bp, Homo sapiens
gatctcatgatgattcagaccacagtctgggttaaagatgtcttgacctctgaggctagcataacatatatgagaatacaacttgcctatttccagaaaatctgtatatttttatagaataactttatttacaatttctatcatccaattactcactaggcattatttgtagtactttttttctctttgaaatctcataggatagtcacacttataaacattcccaatattcggattctagaagaaatgcaattcattaaaattttcctggcactgagagttaatctttagcagattgcatgaaaatactgaattcctggtaaggagatattttgttttaaaaataatgtgttttgatacgaatcagtgtattaactgataactaaaaagtactcttttttctatatatacatatttttttgaactcatattcacaatcaacatattcaatcagtgagttaagtctcattcctagctaccaaaattcctgggccacttttaaacactaaacatttcatttatcctctaagctaaaatggtgctgagttatttaaatctgaatgtaaaatgcattaaatcttagcttgtggtatataaacatttaattaatataaaactgcttgctataaactaagtaacatgtcatttggtgttaggtttttagtgaagttttagcttctcccaaatttttcaggaatgttatttgtaagacgtgtaacttttttgaagaactcttattttaaatgctcagacattggctttatgttcctctttgcattctcatattcttttattatacatctatactatgattgcaagattatataaaaatgccttgaataaatgatttcaagtgtcaata

SEQ ID NO: 90991 - DNA, 128 bp, Homo sapiens
gatcctcctgtcttagcctcctgaatagttgggatcataggtgtgtgtgaccatgtccggctaattttttaatcatgtttttgtagagataaggtcttgctatgttgcccaggctggtctttaactcc

SEQ ID NO: 90992 - DNA, 200 bp, Homo sapiens
agccctcatgatccggctgtgtttctctgagggggatgatggtccacgtatttcccccacatccccctaagacccagaacttttctgttcttcaaccccagcatactaagttgcatttctgggccacttttccattaccaattcctggctcataccccacctttcttcatccttggacatctggatctgcactacctctg

SEQ ID NO: 90993 - DNA, 602 bp, Homo sapiens
gtcttgaactcttgacctcaagtgatccattcaccttggcctcccaaagtgctggaattacaggtgtgagccaccgcacctggcctgtgtatttaccttgtatgctactacattgctgatttcatttattagttttttttttttaattcttttttaaaaaagaaaaaacagacacagtctcgctctcttgctctgtcgcccaggctggagtgcagtggcacaatcttggctcactgcaacctctgcctccagggttcaagtgattctcgtgcctcagcctcccaagtagctgggaccacaggtgcccaccaccatgcctggctaatttttgtatttttttgtagagatggggttttgccaggttttgccatgttggtgaggctggtctcgaactcctgacctcaagtgatctgcacacgtctgactcccaaagtgctgggattataggcacaagccaccatgcctggcctcatttattagttctaacgtgtgtgtgtgcacacacgctctttaggcatttctacttataagatcctatctgcaaatagagataattttacttctttcttaaaaaaaattcactggccgtcgttttccgtcgg

SEQ ID NO: 90994 - DNA, 544 bp, Homo sapiens
gtcttgaactcttgacctcaagtgatccattcaccttggcctcccaaagtgctggaattacaggtgtgagccaccgcacctggcctgtgtatttaccttgtatgctactacattgctgatttcatttattagttttttttttttaattcttttttaaaaacacaatcttggctcactgcaacctctgcctccagggttcaagtgattctcgtgcctcagcctcccaagtagctgggaccacaggtgcccaccaccatgcctggctaatttttgtatttttttgtagagatggggttttgccaggttttgccatgttggtgaggctggtctcgaactcctgacctcaagtgatctgcacacgtctgactcccaaagtgctgggattataggcacaagccaccatgcctggcctcatttattagttctaacgtgtgtgtgtgcacacacgctctttaggcatttctacttataagatcctatctgcaaatagagataattttacttctttcttaaaaaaaattcactggccgtcgttttccgtcgg

SEQ ID NO: 90995 - DNA, 488 bp, Homo sapiens
gggattataggcacaagccaccatgcctggcctcatttattagttctaacgtgtgtgtgtgcacacacgctctttaggcatttctacttataagatcctatctgcaaatagagataattttacttctttcttttcaattttgatgccttttatttccttttcttgcctaagtgtgccggttagaacttctagcactgtgttgcatagaagtaatgaatgcagacatccttgtcttgttcctaattttagaggaaaagctttcagttttcaccattgagtgtgttgtggctttttcatatatgaattttattatgttgaggtagttttctctattcttagtttgctgaatgtttttaatcatgaaagcgtgttgaattttgtcagtgctttttctccgttaactgaaaaaatcatacatttttggaaatggaaatgcagccacatataatggccagcctgggctctcctggtgcccacttgccccagcc

SEQ ID NO: 90996 - DNA, 613 bp, Homo sapiens
gggacagggtggagcggggaggcctgtgcaaagtgggaaagagctgccggtggcctgagccagggtgctggggctgcgggtggggaaaggaggccccagcacttcagacaaagaccaccccttcacccactggaccccaagccgcaaaagctggggaggtaggaagggtcactgtgagggcccagggcccctctcttcccatctcccttgtcctggtggccttcagtgtctcttccagttccaggagctgctgggaagctggccttcattgttggtgacagggcaaccatgggactaggaggtggcccatacacatggctggctggtcctgaggccacccaccttgttccaggacatgggcccgggcccggtgtgggggtagacgcagagggcagagggtagcccttggtactgtgggtccctcaaagaggagagtggggtgcagaaatgcctcagcatggctcatgcacacagcattctcccgtggggcagggttccctcatgcaacaggcctccctgtggccagcctctctgcctgtctctcgctgcgtccccccaaccccttgtgttctattggttcattgttaataaatatcaaatgaggtcacgctcc

SEQ ID NO: 90997 - DNA, 680 bp, Homo sapiens
cagagtaaaaatgtatgttaaattaagcttttttagaatttagcacattgcatgttgaagatgattaaactgtattctgcacttaattttagtaataatactgtagaataatgcaaataagtaattatgtgaatgtcattaggtaataatattttcaacctaagagaaagaagatacaagtgtgaaataaagaagtcaaattaccctaaattgttttttttgagacaaagtcttgctctgtcgcccaggctggagtgcagtagcacagtcttggctcactgcaacctctgcctcccgagttcaagcaattctcctgcctcagcctcccgagtagctgggattacaggcatgtaccagcacacttagctaattttttgtatttttagtagagacagggtttcaccatgttggccaggctggtctcgaactcctgatctcaggtgatccacctgcctcagccttccaaagtactgggattacaggcgtgagccacccacttgacctgaaaccctgatagtctttactttgaattgcaaatatcaatagaaacttgggacagagttttttgttttgttttgttttgtttaaagaaaaaaaaaatcctaactctggacactttaaacaggcctagaagcaatcacaatccagtagcaattaatgtccatccctgagtgtggtct

SEQ ID NO: 90998 - DNA, 181 bp, Homo sapiens
cttcttcccactctctcctccccactctcctactctgcacccaggaggggcatttgaaaatgcttatctgcccatgtcacacctctgctttcagtccagtgccttccaatggccaatgtggtctggctctgacaacttctccaaacacattctccatctccctgaccacaccagttgctca

SEQ ID NO: 90999 - DNA, 376 bp, Homo sapiens
gctgtgctgagaggccccagcccctggggttctctcatagaaacaactggaaagaaaggaaatgccttgggcagcagcagcagcagctgtcttctgattctgctttccgccctgccttccttaccaagagaaagtacagacacggacggcttgagtcacttaggcacttaggagttgtttttcacacgtgtggtgttttcgtcaccattactattgtgggaaagaagacaactcaggcatcgtttcgtattcactcatctgtgtgggtgacatgtgggttttggctcatttctgcatatttgtgtgcaaaggagagttttttagtaaacagtcccattacttagctgttcttgtaactctgaaaacccaactgaac

SEQ ID NO: 91000 - DNA, 262 bp, Homo sapiens
tatttcatcttgatttccaatgattgtttttaagtctttatgtaaaattaatagaaggaggtaatttacaggtcctgttaatgaatttgaatgcaaaatactgtgtgtattattgttaattgactttaataatagtgtcatacattatttaaattgaatttatattttatttcatatatgtgtatgtttgggggacatttttaataacttacatttgagtgaaaatgcaaaaatatttcttccaataaaaatgttgccagtt

SEQ ID NO: 91001 - DNA, 240 bp, Homo sapiens
gacagattataaaacacaaaggcccctctaaggcccttcggatgtgttccagcaatatgcagcagccccccacccccttttttatttcccctgtgacagggtctctctctgttgcccagtctagagtgcagtggcacaatcttgtctcacttcaggcttgacttcccgggcttaagctatcctcccatctcagcctctcgagtagctgggatcataggtatgtgccaccatgcctggcta

SEQ ID NO: 91002 - DNA, 389 bp, Homo sapiens
gagatgaatgcgttccctaggtggttcttgtgtgtataaaagaaaatttattaaggaaacccagagacctgagttgtagttgtgaatttgataatatcaaatactacagaaatagaagttttagtccttactcctgtttccagattcctttgttcttaagtctgcttcttctcctaggttttctttaactgtttcagtaatttcttaagcaagaggttggcaaagggcacaggtttggggaagcagtggtttccaaagattctgtagcatagagtatgagaaaacagaattgtagtgtgagcaggtgtcttaaatcatgtagcaactcacattgcttgcataagacttgggtaccagtgcaactcttgatatccttgattagagtgttg

SEQ ID NO: 91003 - DNA, 444 bp, Homo sapiens
cccaggcgaggacagcgtctggggctgcgagggctgtgtgcccgggaggaggagcggcgggggcgggctcggggacggggaatcccgttggatggcggtgtgggccggtgggcgggagccccagcgcccaaagggcgcgggagggcggtggcacctgcgggggcctttagcgaggtggactctggggacctggagctgtgcttggggagggctagagaccggggctgatcttgcgatggctttcggggatgttgaggaggggtagcagtaaaaacaaggccgggactagggtgaggtgagtaaggctcccaaggcacaaagtgtaaaggagcactgactcagggtcgcgcaagtgcagtgagcgcctcctcacgtgcgtcctgggtgcctcggtcgcctcaccccaggcctggccctgagcaagaatctccttcactccagact

SEQ ID NO: 91004 - DNA, 164 bp, Homo sapiens
cctgctattttgttttattggaacaaaagcagttaagacaatgaatttacttctaagtatagctttggttaaattgtagacactgatatgtaatgctgtctttctcattgttttagaaacctgctatttaaaaatctttttaatttattttgtgagacaagatc

SEQ ID NO: 91005 - DNA, 234 bp, Homo sapiens
taataaatggcattaaaataaccccattttaaaatattgaggtataatttacatacattaaaatgcatcataggtgttccatttgacaaaatagatcacattttctttactcctgaaaatttccttgtgctcctttccagtcagttctcctcttcccagtagccactttgtggtataatcccaggttcccaggttaatgaaattatttctaactgtgtttttaatacattcaca

SEQ ID NO: 91006 - DNA, 684 bp, Homo sapiens
caagccaccattgtctcttgtctggacaactacgagagcctcatatcttcccctgtccctgtccactttattccctgcaggccaagtgggggaggacagtcttcatctgggtgctgagcagggcttggagaggatgagggtatgggaggcggagtgttaaagtgcatgtatgggccaggtgcagtggctcacacctgtaatcccagcactttgggagactgaggtgggtggatcacctaaggtcaggagtttgagaccagcctggccaacatggtgaaaccctgtctccattaaaaatacaaaattaggctcttgctacttccttcttcccgctgccgggaacacaagcaaaacgttgagggctgcagcagccatctttgaccatgaagtaaccttaagaaaggaagccattctccctctctccttctcgcgtcatagctagctccagagaagagaaaaggagggagaggagggagggagaggagaagaggagaagaggcgagggaacgagagagggaagaggggggcgggaaggagggagaagagaagagaaaagaaaagaaaagagaaagaaaagagacagaaagaaagagaagacgagagaagaaccagaagcagaaagaaacagagaaaaacagaagaaggagaaaagaaaagagagaaaaagcaagagagaagagagac

SEQ ID NO: 91007 - DNA, 358 bp, Homo sapiens
taataccagcttctcaggaggctgaggcaggaaaatcgcttaaaactgggtggcagaggttgcagtgatcgtgccactgcactccagcctgggagacagagcaagactccgtcttgcaggaaaaacaaaacaaaacaaaacaaaaaaactgaaaacaatcccaaatgccctagcctatagaagacagattaaagaaactatagtttctgccaacgctggaatactatgcagctataaaacaaaacaagagcaagaaaaaaataaggaaaaactgtgtaatatgttatcaaatgtataaaaaagagaaaataaaagaatttttttttgtatatgcatagtctatttttggaagcataaa

SEQ ID NO: 91008 - DNA, 294 bp, Homo sapiens
tgcaatctccctagggcatccaactgctgatcccgcagtcttctcacgggttcccttgccccccagcacccctgcaatcaccctaccctaaggtttcctcctgctgaccatgcgatgttcttagccgttccttctgaaatcgctgcagtctgcttagatgttccctctgccacacgctcagggctgtcagatgttccttccaccagacactccatctcgtcggatgatctgccacgcgttcaatcctgtcaggtgtccctctcagtcacacgtgtggagcggggcccgagaggg

SEQ ID NO: 91009 - DNA, 532 bp, Homo sapiens
acaccaggcttgagtcagttttggccacatcccgccaaagctctccttccctgcgtggtttgaagggcctctagggttggggaacttgctgagacccacaggccaggtatatattcctcaagctgcttgcagggaggctcagagacagtaggaatgcctttcctgctcctggcctatcagtgcatattggccaggggaatttaatagaaccagagcaaatggaattgtattttaaactcactgggcagattccccaaagtgcttacatgtgtgggtgtaggggtggatttgaattccagctccaccactttttacctcaaagacttgcacgagctacctttctgcaccgccttctcatcagccctaaataaagaaactaacatgaagccctgcccaaggagagtctgagctcagactcgcctaaccctgcccccacctgatggtttgtctctacctgccctggtagctgaagaaaaaagacataatcttttggaagttctgtggtcctgtccattgcctaagaaacccgagt

SEQ ID NO: 91010 - DNA, 489 bp, Homo sapiens
agtcaaaagacacttatattttggactgaatgaaagtgaaaatacaacatatcaaaatctgtgggaggctgctaacacatcatttagtgggaaatttatagcactaaatgcctatattagaaaataataaaggtctgctgggtgcagtggctcttgcctgtaatcccaacactttgggaggccaaagtgttgagtccaggaattagcaatcagcctggccaacacagagcataaagcatacaaaaaatgctttaaaaattagctgggcatggtgacatgcgcctgtagtctcagctactcaggaggctgagatgggaggatcgctttagcccaggaggttgaggctacagtgagctgtactccagtttgggtaacagagcaagaacctgtctcaaaagaaaaaagaagaaaagaaaataatcacatcttaaatcagtgagtccaactttccttttacaaaactagaataagaagagatattaaatttaa

SEQ ID NO: 91011 - DNA, 394 bp, Homo sapiens
gtgggtggggactctgcccggccgcccggagggtggtcccgcggcaggtggccggcccagggactctgctgccatccccgcccggtggccgccctgacctagggcgcctggctctccgcttgtccctagaacccgggacgcgccgcctgcacctctcgtctgggtccccaagattgctttgaggaagtctcccctaggtgggcttccttgtgacccagtgtggcctggaaaggccgggttcctcaagccctccacatggtttggaatgagaggaagttcttccgcctttagcaagacaccgtattctcagggtgttcctttctgcgtagtagaaaacttcccaggcatgggcaggtcagagtcattctaaaacctgcgcgtacacagagcggca

SEQ ID NO: 91012 - DNA, 847 bp, Homo sapiens
tatacacactacttgggttaacagttctgagacaataaaagaaagacacaatcactgtgttcagttcagttgcttcaaatgtaaaaaaaaaaaggctgtataaaagtgaatatcaggttagtagtctgaaatattgcctattgatctaatcaaaagagaacattcaaaatgaatgtagtccaggtttatgtaatatttagaacaagtcaaatgcttagtacttttgtggtaaaagttttatgattcttgaatactaatggcagaaaagtcaaggactgcaatgataaagtcgaaataaaacgtgaaaccaagtggaattgctagaatttgagtcattaggaatgaaggaaaatcagagcagaaagaacagtgtaatgatttaataggaatctttgcttcctatgtcagtccaagatttatgtgaacaagagtttttgagaactcatgatggaaaggagaaaaaggtgaaaaaggattttaagccttagctcgttgattttagatttgagatttgttaaacttctcacagtgagtaataaaaaattccataaaaagaatatctgttggccaggcgcggtggctcacgcctataatcccagcactttgggaggccgaggcaggcggatcacaagatcaggagatcgagaccatcctggctaacagggtgaaacccgcctctactaaaaatacaaaaaaaattagccgggcgtggtggcaggcgcctgtagtcccagctactgggaggctgaggcaggagaatggcgtgaacgtgggaggcagagcttgcagtgagccgagattgtgccactgcaatccagcctgggcgacggagtgagagtctgtctca

SEQ ID NO: 91013 - DNA, 890 bp, Homo sapiens
cctcctagccctcttacccctcttagccctctttacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91014 - DNA, 713 bp, Homo sapiens
aatcgctaggagagcgcggtaatcggccgagactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcggcacggcccaaaagccccccgtgggtacccattccccgctaaaactccggaggggggggaaaatctcaagacccgggtgtccggtgtcggaagagctcaagggctggcccaacagagaaactcgggac

SEQ ID NO: 91015 - DNA, 2255 bp, Homo sapiens
tgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtctt

SEQ ID NO: 91016 - DNA, 2337 bp, Homo sapiens
tgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacagtttttatacaaagtgggaccttccatactttttgtattacaataacctttcagtctcaaaaaaaacaacaaaaaaaaaccgcttggtggcaaaacattttgtggttttcctcggggggccttcctttcctttctcttttaaaatttatcccaagaatttttcacttccaccggttttttttcccacagggtgagacactccggttctccaaaaattgatttgatctgaatttgactgctttgattgaacgaaccgaccaggtggcttcacttgtccggaaaacttcttagctattggctccccaaaaccttttcatggttttaaaagacgcttataacttaagggggatacaactcacgtgtcttttcagcaacattccttttgtgttgtgggcccataaacagagcgagatcctgtggaagtatgtcaccagacaactggtttgatcaggtacccggcatattggcttctttttgcccacgtccatggctcggttacggaaccgtttcgagactggccacaagtgcctggcccgttcagtgtccacgcgcgaccattgggcgtttaaggcaaccgcaccgacgtcgtggttatagaaccg

SEQ ID NO: 91017 - DNA, 3408 bp, Homo sapiens
gctagtacgaggcctgggttaatcggccgaggattggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91018 - DNA, 1752 bp, Homo sapiens
tgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattaaaaaaaaaaaaaaaaaaaaaaaaaaagaagaaagaaaaaaagagaaaaaagaaaaaaagagaaaaaaaaaaaaagagagaggaaaaaaaacaatgaaacctgaaacagagaacgaaaaaagagaacaggaggtcggcgacacagaacataaacaagcgaagaggcagacaagaacaaaaacaaagcagaaagaagaggaaacacacaaacaacacaaaaaggagaagacgacgcgggaggggggagagagaaaaggaagaggagagggggggggagagaacgacaggagagaagagaagaagagagaacgaagaaaaaagcattgtgaagtggggggcataagaaaaagacgaagaggtgcaatcctacaagggtataatatgtttaggcgggcggatgaggtatagataaagtagtgagagtcagtaatcgtgttgtgatagcgtaggggcttggaggatcatggagggggagcgaaggtgctgaaggggaggtgcgacgaa

SEQ ID NO: 91019 - DNA, 2787 bp, Homo sapiens
ccttaagaagaaactgaaacgtatgatttgagaatacttggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91020 - DNA, 2760 bp, Homo sapiens
tgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91021 - DNA, 2182 bp, Homo sapiens
cccacgcgtccgcggacgcgtgggtcgacccacgcgtccggagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91022 - DNA, 2037 bp, Homo sapiens
gcggccgcctactactactactaattcgcggccgcgtcgactttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91023 - DNA, 771 bp, Homo sapiens
tgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcaggtatggtataggtttgtcttaattaacctgccaggttttattgagcacctgttatgtgctagataccacactgagggtctgagaacacaaaaatgcatatgcaatggccccatcctttgggtagcacaaagactagtgagggagacaaacccataaacttccatgatttaaaggaagggactagattgtttctgggtgagggctgccagtgctggccccactggggagctggctgtgaaaggggcaagtaagctttcagttctgactttctcttttcttttcccccaccga

SEQ ID NO: 91024 - DNA, 3514 bp, Homo sapiens
tgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91025 - DNA, 3035 bp, Homo sapiens
tgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaataaaaaaaaaaaaaaaaaaaaaaaaaatggggggggggccggggcccgcggaaaaagcttttctaagaacaattcgggggggggggggggccccaggagaggtaaggggaaccgggggccaaagggggtcccaaagggaaaccggggccaggaacaaggggggggattctctcccaccaaataaaaaaacgcgccgggggggaaccgcgagaggggttcgggaacaacctccaagaggggaggcggaagggccaatacagggggactcatatccaacgggggtcccaaaggaggaaggcccggaaatctaaaattaacgcccgggagggggggaggaaaacaacgacacaaaaaaaagagaaacaaacacaaaagaagac

SEQ ID NO: 91026 - DNA, 3486 bp, Homo sapiens
  misc_feature (20)..(20): n is a, c, g, or t
tctagtcgaggccggtggtntggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91027 - DNA, 3448 bp, Homo sapiens
  misc_feature (20)..(20): n is a, c, g, or t
tctagtcgaggccggtggtntggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91028 - DNA, 2717 bp, Homo sapiens
agaggatacaaggatacgtagatcagagagcagattgccgctggagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggaga

SEQ ID NO: 91029 - DNA, 872 bp, Homo sapiens
tgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcaggtatattctgggtagaagacagcactcta

SEQ ID NO: 91030 - DNA, 1809 bp, Homo sapiens
tttttttgacacagggtctcactctgtcgcccaggctagagtgcagtggcacaatgaaggcacactgcagctttgacctcctgggctcaggtgattctcccatctcagccttcccagtaagtgggactacaggtgcccaccaccaagactggctaattttttgtatagacagggtttcaccatattgcccttacactcctggactcaatctgcccacattggcttcccaaagtgctgggattatagacatgagccaccacacccagcctgtatggctgttgtgaataatatgctgttatgaacacgggcacactaaacaccattcaacttaaaaaaataatcaaagccttaagaactgaccaaaatggcttaggtgaaaataaaataccaaactctgctctaagaaaaggaaagaacattcactgaattataccttcagcaataagcacgtaatggaacttgtttcatttaaaatgcatcacaatcctgtaaattgataatcatcataccgcaattttatagatgagcaaggtattaggcggacctttttcaaaaggtcatacagctagtgacaaatatttccaaatttttcataacatttctttttttgagacggagtcttgctctgtggcccaggctggagtgcagtggtgcaatctcggctcactgcaagccttgcctcccaggttcacgccattctcctgtctcagcctccctagtagctgggactacaggcacccaccaccatgcccggataatgtttttgtattttcagtagagacggggtttcactgtgttagccaggatggtctcaatctcctgaccttgtgatcctcccgccttggactcccaaagtgctgggattacagacatgagccactgtgccaggcctaacatttctgttttaaatagcttaattaactacacatgttttatattcttgcctctgaaaggcagctttttttgttgggttggtttattatgcatcagacacttgattcgctgaggaattctgtttttcagtaattcatccaccacaaatatcacgtagcattttgactccacagacctaagagtcttaagtcttaaaaggattgtaaaatctaagtttttctgagctatctgagagtaagaggcttttttctattgaaaataggttgcatttcaaactttatccgtaagagctcacaacactttctccaacatgcatgcccatgtgctcacttaaacagaactctgagtgagacagtaaatacctcatatgcccttgaaaattttaccttggcatagaaaaaccttgttaagaacctaaaaataatttcactttgaaagtctttagggttagacaaatgttaaacttcaattggcagtacaagggcagcactcaagccagtaagagttttgttgggccaaattatgttgaaaaagatcaaatattttaaaaacaggagatttcacataaaaatctgggattccagcttcttctgaataaatgaggtacactaattatgcagagtggcaaatggctggagttgagtgggaggtgtttctagcccaacagataggcatggaagctccagctcagccccctccactccattttcttacacaagggaagccactatggtatagcatctaacttaaggcatattatatgtattcttaagacagaggaaaaggctgaatatttgatattgtcaaaagaaatgagagtctaactttctgtggcaaggaccttcttgcagtagtaacatagtctggaacacctccaacataaattatgaaaagaaagctcttggctcagaagag

SEQ ID NO: 91031 - DNA, 1840 bp, Homo sapiens
tttttttgacacagggtctcactctgtcgcccaggctagagtgcagtggcacaatgaaggcacactgcagctttgacctcctgggctcaggtgattctcccatctcagccttcccagtaagtgggactacaggtgcccaccaccaagactggctaattttttgtatagacagggtttcaccatattgcccttacactcctggactcaatctgcccacattggcttcccaaagtgctgggattatagacatgagccaccacacccagcctgtatggctgttgtgaataatatgctgttatgaacacgggcacactaaacaccattcaacttaaaaaaataatcaaagccttaagaactgaccaaaatggcttaggtgaaaataaaataccaaactctgctctaagaaaaggaaagaacattcactgaattataccttcagcaataagcacgtaatggaacttgtttcatttaaaatgcatcacaatcctgtaaattgataatcatcataccgcaattttatagatgagcaaggtattaggcggacctttttcaaaaggtcatacagctagtgacaaatatttccaaatttttcataacatttctttttttgagacggagtcttgctctgtggcccaggctggagtgcagtggtgcaatctcggctcactgcaagccttgcctcccaggttcacgccattctcctgtctcagcctccctagtagctgggactacaggcacccaccaccatgcccggataatgtttttgtattttcagtagagacggggtttcactgtgttagccaggatggtctcaatctcctgaccttgtgatcctcccgccttggactcccaaagtgctgggattacagacatgagccactgtgccaggcctaacatttctgttttaaatagcttaattaactacacatgttttatattcttgcctctgaaaggcagctttttttgttgggttggtttattatgcatcagacacttgattcgctgaggaattctgtttttcagtaattcatccaccacaaatatcacgtagcattttgactccacagacctaagagtcttaagtcttaaaaggattgtaaaatctaagtttttctgagctatctgagagtaagaggcttttttctattgaaaataggttgcatttcaaactttatccgtaagagctcacaacactttctccaacatgcatgcccatgtgctcacttaaacagaactctgagtgagacagtaaatacctcatatgcccttgaaaattttaccttggcatagaaaaaccttgttaagaacctaaaaataatttcactttgaaagtctttagggttagacaaatgttaaacttcaattggcagtacaagggcagcactcaagccagtaagagttttgttgggccaaattatgttgaaaaagatcaaatattttaaaaacaggagatttcacataaaaatctgggattccagcttcttctgaataaatgaggtacactaattatgcagagtggcaaatggctggagttgagtgggaggtgtttctagcccaacagataggcatggaagctccagctcagccccctccactccattttcttacacaagggaagccactatggtatagcatctaacttaaggcatattatatgtattcttaagacagaggaaaaggctgaatatttgatattgtcaaaagaaatgagagtctaactttctgtggcaaggaccttcttgcagtagtaacatagtctggaacacctccaacataaattatgaaaagaaagctcttggctcagaagagaaaaagcaaaaaagaatactcattaattcta

SEQ ID NO: 91032 - DNA, 243 bp, Homo sapiens
atgctgccgtggacctgggtgtggatgatgctgctgtggaactgggtgtggatgctgctgtggacaggggtgtggatgctgctgctgtggacgggggtgtgggcgatgctgctgtggacctggatgtggatgatgctgccgtggacttgggtgtggatgctgctgtggacaggggtgtggatgatgctgccgtggacctgggtgtggatgctgctgtggacaggggtgtggatgctgctgtgg

SEQ ID NO: 91033 - DNA, 349 bp, Homo sapiens
aatagattctgtgggattttctaggtaggcaattatgttgtttgcaaatagggacagttttatttcttccttcctaatctggatatcttttatttatttttcttttcttattgctccttttcttttttaaatttttttattttattatgattatactttaagttttagggtacatgtgcacaacgtgcaggtttgttacataggtatacatgtgatgttgaataggaatggtgagcatggtcattgccttattcccagcattacagggaaagcgttcagtctcttatcattaaaatatggtgccagctgtggtgattttacagatgccctttatcgggttgagaaaatt

SEQ ID NO: 91034 - DNA, 239 bp, Homo sapiens
tgctatattttgtattggacataaatattaattgttctcatgaacatcagcctatagggaggcctatagcctcccgatctaaccccctaccaggtgtagccagtatatctaaatggagctctcacctgcctgtctggtacctttggttcctcaaggtgttgagagcctcatccagaattacagttgccagaatcagcagactgaggagcagatagagttggaggggccagcctacttaa

SEQ ID NO: 91035 - DNA, 465 bp, Homo sapiens
aaaaaaaaaaaaaaaattctttttctggtgtttgaaggtgtagctgtgatgtttccccttttcttagtggcatttattaacttgtagaaaatctggaatacaccaaaactatagttaagaaaattaacactttgtttctccgtctttcccatcaaagcattgtggatggttcctttcagtcttttttctttttgtgtatgtaggtttacacagggaatgcacaagattggaattattcgcctatacaatgtttatatatttttccactcagcttgagcatttgccagtatcatcaattattccaaagtgtgatttttaaaagaaaaatggactcaatattccaacatatgggtatactaaattgatttattcaactttttcaccattaaataatcacagaaccagtgtttgatatcttgttgctggtggataatagtaaaaataaaatcctaatatttgtgtcat

SEQ ID NO: 91036 - DNA, 368 bp, Homo sapiens
acaggagccccggcaataccagaaaaatgaagcaaatgaggagtcataaatatcactggagaccgggcctgtgccaggactgtcagagtacggaacagtgccaagaacttctctactttaaaataacttttggctgcacgcggtggctcatgcctgtatcccagcactttgggaagcagaggtgggtggatcatttgagctcaggagttcaagtgatcctcccaccttggcctcttaaagtgttgggattacaggcatgagccaccacacctggcctctagtgtgtttactgtgtcttctcagtttctaagtgttcttccaaaatgtgaattcttttgtgtgtcacttcttttttttatttttttttt

SEQ ID NO: 91037 - DNA, 355 bp, Homo sapiens
tgactgtaggtttgcacttgttgaccaacctctcttcatctctcctatctcttccccacccagtggtaaccactattctactttctacttctatgagataaacgtttttagattccacatataaatgagatgcctggcttatttcacttaatataatgacctctgggttcatccatgttcactgcaaatgatagaatttcattcttttctatggctgaatagtattccattgtgtatatatgacatattttatttatccattcatacactaataaacacttaggttgattccatatcttggctattgtaactagtgctgcaataaacataggagggcaggtatctcttcaacaac

SEQ ID NO: 91038 - DNA, 523 bp, Homo sapiens
tctgccttcctctccccgctgcttccatcctgccctccccaggaatctcctggtttctgtggctccgaccctcctcctcagaaagctcaagctcattccaggctcttctgtcatgtcaggcatgtttgttgctgaaactgggcatgggttagacttgtgtacacaagcagtttgtggcagacctgctatgtgcttcagggcattggcccagctgctggggggcaaatggaatcagctacattatccttagtcttgctctcaagaaaatcctgccttttggggcagaggaggtgggcagatggttggacaactggctgcccaccaaggcagaacgccattgggcctcaacagagcagtgagcagagtgccagcaggtttgacctctccctggagaggcttgtcagctgagcaccgtgagagagcaggatttgggtaggcagagaaccagagaagggaattccaggctgagggaatggctggagcaaacgcttcgaggtgggaggatgccttttctgttgggggc

SEQ ID NO: 91039 - DNA, 326 bp, Homo sapiens
ctttatttagtgctggggctttggaagcaaatgtacctgagtttgaatctcagggataaccttttgactgtggccctgggtaagttactcactgtctctgaaacttcaagttcctcataaataacctaagatggacaatcataactctctcttggattgaggtaggagaatatggtggaggcagggaaccgaaggccatttcactccaacttcctagaactaaattaaaaggaaaaccctaattttccatgcctaagtaacaaaaggaccaaaggttactccgtttgcaaactcccaccttttctgcatggcagatgggaagttgg

SEQ ID NO: 91040 - DNA, 425 bp, Homo sapiens
taattcgtcatggataggatggtcttttcaacaaatgatgctgaaaaatttgggtatccacatagaaaaaagaaacttgaatccctacctcacactatacacaaaaattagagatgaatcacaatgctcaatgtaaaagctaaactataaagctttaataaagaaaacagaatatcttcatgccttagcataggcaaaagtttcttaggacacagaaacaacaaccacaaataaaaaaataataaatcagacttcgtaaaaattttaaaattttacttccccaaaaaactagctgcaagtcaacaagtacaacaaacctagtaaaaatcagtaaaagagatgaataggtagttcgcaaatgaagagtatgtgaatgatcaatcaatgtcttcagcatcgtcagataacagggaaatgcaaatgag

SEQ ID NO: 91041 - DNA, 343 bp, Homo sapiens
ccaaaaagtgaatactgcctccaccacctattagctttgtgaacttgggagatttacaacctctgaacctcagtttctagaactgtagaagatttattagagtaagtccttctgtacagacctgtttcaaggattaagagaccaatgcggggcatttagtacggtggctagcattgaataattgttcagtaagtactagctctcattctttccaagttgttcctcagtcatctaaatcattcacatattaagtgagaatccacaggcatcagagctacagaagccaatagggacaaaactcctgttcttaatggagattacaaggctacatgtagaaagcttt

SEQ ID NO: 91042 - DNA, 358 bp, Homo sapiens
ttttttggttgaagataatacagtggcttctttttacattttagtaaaacttttttgggtggaggggagtgttatttaattattaaatgtattctgatggaccatgtccttttaaatatgttgaggtagtggagcttataaggcagttactatgtttaactctcctaaaaatagaattccaaaaaggtttttgcttggagttcagattcacactaagctattatttcaaataagtggttgtttacgccacttcatttctttcactacatgtaacagcattaataacaaatatagtatcacagatttacttatgtttagcctaaattgtgcagtcatttaattgatgagatggtgagaa

SEQ ID NO: 91043 - DNA, 443 bp, Homo sapiens
aacagaacaaaatagagagcccagaaataaactcatgtgtatatggccaaatattctttgacaagagcaccaaaaatgcaaaatggggaaagaatagtctcttcaataaatggttctgggtaaactggatatccaaatgcaaaagaatgaacttggatctttatcttataccatacacaaaaattaaaatatattaaagtcttaaatgtgagacctgaaaccataaaacttctagtagaagaagttgggaaatggctccttgacattggtcctgacaatgatttttttggatgtgaccccaaaagacaggtaacaaaagcaactatatcaaactaaaaacttctgtgcagcaaaggaaacaatcaacaaaatgaaaaggtaacctatagaatggaataaatattttcaagcccatatatctaataagggattaatatccaaaa

SEQ ID NO: 91044 - DNA, 676 bp, Homo sapiens
aaaaaaaaagagttctgtttggttttatggaaagaatattactttttaacaagaaaatgtctttcttttcatgagccattttcttactgcatttaatcatattattaagataaagtgcaatttgttatgtggacaaatgtatatccctttacaattatatttgtttctattgcatacatttttctggaagaagtcttattttcacatgcaaaatttgtgaatggtgcctcagagcctcagaagacagaaagttaacagctggttcagtctagaatgtgtttctttgattctcttttttctttattttaggaacttagcttagtttttccaaaatgattgaaaggtctccgttgattttctctgctgttatttgtgtctgtatttgatataactttatatcatacatctgaaaactatcacataaactctacttggcaaatagttcttcacttccatcgatgtggatttctgtgtctttcaaacagcggtgtagttttataaagtatctatctttaattggtatttctaagttagaaaaagggggaaaaaagccagctcaataaatattaatataactggtgactaaccaattacaaaaagaaaaactagcgaaatacttcattttagaaatgtaaaagtgagtaacgacccagttgtccaacctgattaaaaaaac

SEQ ID NO: 91045 - DNA, 494 bp, Homo sapiens
accatggtggccttaacttccttaagacttagtttcttcaactgtcaatcacacttataatgacaatagtgatattattaattgtagcaataacaactgtaaacacattgtatggttagcaggtgctgtgggctgcatcaagttcttttgtttttatgatttcattaaaatctgagtttttttcctacctcgtgcagatgtttttaaggatataaatagaaagaaaaagtgattataaggatactgtgtgtaccagaattttaaaaaattgtaaggtatatagaaatatagaatttttattgaataaataactccctttaaaagaagatactctgatttttagaaagtgaaagattttgattataacaggaggttaattttttttccttttcaaaacttgtacttaatttaagaagtaatgtaaaattttattatgccaaaacagaggcacacacttatggaactgcttaccataaaagtgataacaaaatgtc

SEQ ID NO: 91046 - DNA, 471 bp, Homo sapiens
  misc_feature (20)..(22): n is a, c, g, or t
agtctcactctatcacccannnggctggagtgcagtggcctgatctcggacactgcaagctccgcctcctgggttcatgccattctcctgcctcagcctcccaagtagctgggactacaggcgcccgccatcacgcccagctaattttttgtattttgtttagtagagacggggtttcaccatgttagccaggatggtctcgatctcctgacctcatgatccgcccgccctggcctcccaaagtgctgagattacaggcgtgagccaccgtgcccagccaagaattcttgtataagtcttttcttcgtgagggacttcacaggggactccaagataaccactcctgttcttctccccagcccttgcctgcccctgctgatattttaaactggaaaatacttctgatttgaatattctccctgtgcaaattttcttccctggcatactttctgctagatttcaagagggaac

SEQ ID NO: 91047 - DNA, 190 bp, Homo sapiens
  misc_feature (1)..(3): n is a, c, g, or t
  misc_feature (8)..(8): n is a, c, g, or t
  misc_feature (188)..(188): n is a, c, g, or t
nnncttcncatccccctctgagccaggagcctcctgaccctgtgatgcctgacacaggggacagtcagctttgttgatgccagctgtgctgagttcccatccagagaggtgaggcatggcccagcctggagcctggagccgtggctaagcatttctccagaccactcctggttttcttaacagtttgntt

SEQ ID NO: 91048 - DNA, 304 bp, Homo sapiens
acttctgtgcagttgggagggctttttgtagaagctttatttgacaatgatttttctgttgcttaggtcatttgaggggaaaaacattattttaaagtttaacgttatttctaattgtcttaggaactatcaacatacatggaaatagaaattatctgtgtattgatttgtgtgtaatacacttatgctgagtttttcctgagtttttgatccatagatagataggaatctggtgggagttggaaatatgggcaaaaaatggtgggagggccaggtgcggtggctcacgcctgtaatcccagca

SEQ ID NO: 91049 - DNA, 404 bp, Homo sapiens
ttggagacggagtctggctctattacctaggctggagtgcagtgggacaatctcggctcactgtaacctctgtctcttcagcctcctgagttgctggaactacagctgtatgccatcatgctcggctaatttttgtatttttttgtagagatggggttttgccatgttgcccgggcctgtcttgaactcctagagcttaagtgatccacccccctcaggctcccgaagtgctgggattacaggcatgattataggcctgagccaccacaccccgcctactatagcagttttttaaaaaaagcattatgttaaaactgattataccagatggacattaaatatccatctcagaaataccaaaatttgatacataagcctgggcaacaagagtgaaatccgtctca

SEQ ID NO: 91050 - DNA, 670 bp, Homo sapiens
ctgttaccatggagacagacatgttgtgggcttaggctttaccagcgaacacctcagcacaaaaagctgaattgattgccctcactcaggctctccaatggggtaagaataaacgtattaacatttacactgacagcaggtatgcctttgctactgtacatgtacatggagccatctaccaggagtgcaggctactcacctcagcaggaaagactcaaaaacaaagaagaaattctagccctgcttgaagccgtatggctccctcagcaggtggctgtaatccactgcaaaggacatcaaaaagaaaacacggccattgcccgtggtaaccagagagctgattcagcagctcaggacacagcatgactttcaggcacacctctaaacttgctacccgcagtttcttttccacagccagatctgcctgacaatcccacatactcaacagaagaagaaaaactggcttcagatgttggagcaaataaaaatcaggaaggttggtggattcttcctgactctagagtcttcatatccagaactcttaggaaaagtttaatcagccacctacattctaccacccatttaggaggagcaaaactagcccagctcctctggagcctttttaagatcccccatcttcaaagcctaacagatcaaacagctttccaga

SEQ ID NO: 91051 - DNA, 205 bp, Homo sapiens
gcttgtctcccactgctctccagacccatcactttgtacatgtgttttaaacacatccctacatttaaaccttctgctcatactgcccccactatctagactccctcctccctgccctagtcaatgtttactaaaatccccttcatccctcatctccccattcaagtactttctcaaataattcacccccctccttttttttttg

SEQ ID NO: 91052 - DNA, 345 bp, Homo sapiens
  misc_feature (30)..(30): n is a, c, g, or t
  misc_feature (294)..(294): n is a, c, g, or t
  misc_feature (314)..(314): n is a, c, g, or t
ctgaggattccaggcactcacacttctgancaactagctacaaattcatatgttctcatcaactcctcagcctcccgaagtgctgggattacaggcatgagccactgtgcctggccactaattatttatttttatgttacattaacagatgtttataatcatttctatgcttttatcttttaaattttagagaaaaattaataatgttttctgcatgattattaaaatgctaaggaattctgtttttgtgtagagcagaggaggtcccagataccaagtggcgcctcccagganaggctgggagaagaggtggnctggagtaccccgagatcccagcagcgcaca

SEQ ID NO: 91053 - DNA, 127 bp, Homo sapiens
gatcgactgagctcaaatttcagttggggccctattagtctgcctttccaaaaagggcgttgggactttaatttaaaacttaaccagttgaaaaataaaggtggcgtggaaatgctttttgatttgc

SEQ ID NO: 91054 - DNA, 223 bp, Homo sapiens
ctttcttaaaggttttatcaattatactttctccagccgtgtagaagaatgcatgttttcccacccctttacctattctatgtgtttgtcataaaacattttttaatcttttcaaatctgatgttttaaaaatggtatcatatatttgcatttctcttaatgtaaatgagattgcacatcttttcacatgcctaatagccagttgtattttcttttctatatt

SEQ ID NO: 91055 - DNA, 234 bp, Homo sapiens
gctgtatcactagcactcagaacactgtctggcacatggtaaatacttaaatatttgcttaataaatgaacaacattcccaagttaaaaggtaaacatgaaagctcatacaataaaaagcaacacatttcttgcctaaatgctcaacttcaataacaatttttttttctttggagacaagagacttgctctgtcgccctggctggagtgcagtagcatgatcccagctcactgc

SEQ ID NO: 91056 - DNA, 314 bp, Homo sapiens
tggaagagaaaagcaggaaagtcaaggaaatgtaacaacaaagcagcatcagaaagagacaacattccaggccttaaaggtggaaggagtctgtgagccaaggaatgtgggcagcccccacaagctagaaagggcaagaactgattttgtctttgaatctccagaaggaaatgcagccctgctgacaccttgattttagtccagggacaccggcgtcagacttctgaactgtaagataaatacgtttgtattgttttaagccactaaatttgtggtaatttgttgtagcagcaataattaatagacactgagct

SEQ ID NO: 91057 - DNA, 464 bp, Homo sapiens
aggatataagagtgggtagagtcaaggatatcaaactaaggaattacagaggcaatgttcaactctggtaaatcttaaccaaaggtaagacacttgcaactttctagtcatctctttttctccagcccaatgtcattgccctggctcaagcagtagtatcttttcaacatttatgcagttgccttttaactggcctcctttgccattactcaggcctcattttctgtcttctacaacctggctaaccattcttttcctttaaaaatgtaaatctgacagccgggtgcagtggctcacacctgtaatcccagcactttgggaggccaaggcgggtggatcacttgcggtcaggagttcgaggccagcctgaccaacatggtgaaaccccgtctctactaaaaatacaaaaattagccgggagtggtggtgcgtgcctgtaatcccagctactcaggaggctgagg

SEQ ID NO: 91058 - DNA, 471 bp, Homo sapiens
cagaaatgaaataaagatacagtaatgaaaattattaaaacccaaaatagttctttaaaaaaccgacaagcctctggcaaaatcaatgataaaaagaatggctttgaggcgccacacactgcacccatctaaaacagcaaacttaatccataaatgcatgtgtctgctccaccgactggccattcccccatctctctttggccttcctactccctgagacacaacaatcttgagttgaggccagttgataacccccacaatggcttcagagtgttcaagtaaaatgaagagttgcatttctctcactttagatcaaaaactagcaatgattaagccaaatgaggaaggcatgttgaaagctgagataggccaaaagctaggcctcttgtgctaaacagttagccaagttgtgaatgctaaggaaaagttcttggaggaaattaaaagcgctgctccagtgaatgcacaaat

SEQ ID NO: 91059 - DNA, 296 bp, Homo sapiens
cacagtatgtactaatctgtagaaaattatagcatactatagcctgtttttattttacataacccagcaaatgtgaatttgtgatttaaaaaactgagtgggtgtgtctgtaaaatccaaatatctgttcatacccaaacacacttaatcttaatgtttggagaagggcaataatgaaaaagtaaaaaaggattatgtgaatttagagatgggttgaaatgagtaaaattcaagtttgtttaatttttaatgtgtatttatagttagatttccaaatggttgcaacacttaatatt

SEQ ID NO: 91060 - DNA, 288 bp, Homo sapiens
tgagggtaatggaccagggagaagttaagagtaaactgcctgggaagctcaggtggtctctctacatgagcagtgaaagggattattccagggggaagggataggccctcagtgctctcaatgcctcagcaatgttttgggcccatcctcatccccaattctcctacaaacacacataccacccccagagaacccctggctcccctgcaccataaagcgaccccccttcacctgcgaccactcacagaagccgccctccctaccccaggtgaaagtggcccctcggcc

SEQ ID NO: 91061 - DNA, 1171 bp, Homo sapiens
ttctactttaacagtttcacagtctttgccagttctaagtaccttgtagctgtattgctcgtttgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttttgtaagagaaaattaaaggtggttttttttttttaattttgctttattgaggtttatattacacattctaagtgtatggtttgatgagttctaacatgtcttcacttgtgtgaccaccaatacgatcgagatacagaacagcgtcttaccccagaaggttcccttgagatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgatgactaatgatgttgagtgtatttcatttgtattttagtttgcaaatgtttgttcaaattcttcacccgtttttaatgaagatgtacgacttatttttgtgttctgaacagaagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagc

SEQ ID NO: 91062 - DNA, 1536 bp, Homo sapiens
tgaatactgtatcccaaagtatgttagttgtttgtttggaaatcagcattctccccgatgctctattatgggatccaaaattcttgaacataagtttaccctgtactgtgtccaaacactgttctagttctagcctgattatgggtcccaagaataaaaggatgagtaggtgtacagagctcttgacctacaattttttaagagtgttttggtaccttcccattgtcttctctataactcagtcctaacatactctgcactcgagttaccagccatccacactgacatcagatttcaaccagaaccatcactgagtgacagcagtacttctcagaggtatttgcagcttgatgcaaagtagtctctaatgagtaggcattcaggtggttcttcccagcaggtggagaagaaagggaggagatgaagaacactgagaggggagtggcaccttcccaggctgcccagctcagtctcttgccctgttcctgtgactcagctgcccactcccccaactttgtttccctccctcccagtctctgaaagtgtcaggtgtttctctcctcacagtctcttttgcagcaacagtaagacaaaattcaaggcagccttttaaagttacgaacagttattagcatgtatttacagacctaagcagaatgagagtttatacattgtttttagttgcctgtatttatagccaaaagtatattaccttaaagttgagatctttctcttcttttcctaaattttggtaaagtgtgcttcatgaaacaaacatctggaaaactccaagtataagagaccctggactgatgatggcccagccaagtatatggagggacagagttctctctgtcattaatgaggacatcggttttcacaattgaacctcatgcactgtccacagcatctcacctagctcctgtatctcctgatctgcttttaaaaatagttagttaggctgcctttttacaccaccttctctctctccccttgtggtaattttccagccttccccatagatataaaactagaacacctttatgatttggggtctatgtaatgactgaccgataagaacccaggcagatgctaacatacttaacagctcgcattaaaatactttaaatcaggaaaaaaaaacacaaaaacaacagggggaaccaaatacataaaaaatttaccttggaagggagccaacgagaacacagaaccccagagttttattgtaacaagggcaccccaaagcagaggtcgacatatacgaccaggcacctgaccggcatatacaaagacgtgcaagggaaaaccggcaacctgggcacctcggaaggacctacctcgcggctgggacaatagacacactccaccgcgaataacgcacggcaacaaacattcagtcattaggtaaacacagaccatactcgctgaaactgctcagcaatgcaacacattaccaacacgaacagagcacagacaacagaaacggaaccgacaaacgagataacataacaagacacagaagcaagacgacac

SEQ ID NO: 91063 - DNA, 1718 bp, Homo sapiens
tcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttcgtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaaaaaaag

SEQ ID NO: 91064 - DNA, 617 bp, Homo sapiens
atttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaag

SEQ ID NO: 91065 - DNA, 221 bp, Homo sapiens
tagatggatgcggctcaacaagaatttagacaaaaataatgaactataatgtgttgccatgacttagtctctaatgagcttataaataaatccatatttcagcacacatatagttttgttcagtacctctaaaggtggtaaatcaagaattcttatgctacagagaaaacagattctgctattacctaagaaatcaactggaaggcttttttttttttttt

SEQ ID NO: 91066 - DNA, 177 bp, Homo sapiens
aaaaaagaatgttttatcaactttattaaggtttaaagagtaattgacaaaaattaaatatatttatggtgtactgtgtgatgtttatatatatacactacacattgcgaaatacataaagctatttaacatatctatcactttacatatttttttgagatgagaaaatttaagatc

SEQ ID NO: 91067 - DNA, 370 bp, Homo sapiens
attggaagccccagaattgattgggtcagaaattgaaaatgatactatcagtgacccaggtttgaatgtctctctccacagcattgacttcactaatggatgtgacctggttggcagcagtagcttgcacaacatgcttgtttgcagtgagtagtagagagaaggttttgctttcccagaaactctgaaaaaggtcatcaaacctaaatttccttagccttcttcttccatgagcaaatcactagcagatgattgctagcaaggtgttactattacaatgaacccctaagtgtcagagaaagagttagtttggggaaatatcctctccaccacaatcttagtcattgaagtcaatttaacaatatattga

SEQ ID NO: 91068 - DNA, 203 bp, Homo sapiens
aggtcaatcttcctgacacattttgctggttcttcctcatgatccaaacattagaggaccccagggcgtagttcttagacctctattcttctctatctctactcacttctttttttgttgttgaggtgggtggtgcagtgtttattcagtgatcttcctactttctttctttttttttgagacagagtttcactctgtcactc

SEQ ID NO: 91069 - DNA, 461 bp, Homo sapiens
aaaaatctcaaataaacaacttaatattgtacttcaaggagctaggaaaacaaaaacaaactaaacccaaacttaaggaggaagaaaaataataaagattagagtggcaataaataaaattgaaactagaaaaacaatttttaaaatcaacaaaactaaaaattgttttttcgaaaagaaacacaatcaacaaaccttttagctaggctgagaaataaagagagaaaactcaaataaataaaatcataaataaaaagtagacattacaattgacacaatagaaatacaaaggatcatatgagactattatgaacattatatatcaacaaatgagataacttacaagaaatagatatattttgatgcatacaaactaccaagactgaattatgaaaaagtaaaaaaccttaacacaccaataacaagtaaagctattaaatcagtaatcaaaactctcccat

SEQ ID NO: 91070 - DNA, 440 bp, Homo sapiens
atgggaaagggggaggagtccggagctggaaaaccacagctaaagcaaaccctttttactaccatccacttcaaccaccttttatcagagctgtcactaaggggcaaagtacaattttctcgctcctagtgagaggattaagcagcagcaattcagacaagaggaaaggggagactagaggagaggcagagacagggtcaagaccatgcaaggttaggggtcacaaatgggtagctcttcacacccaataggccctattttgtatggcctgcaggtttttttttttttttttaagttggagtattgctctgtcaccaggctggagtgcaatggcgacatctcagctcactgcaacctccgacgccctggttcaagggattctcctgcctcagcctcccgagtagctgggattacaagcacaagccaccacgctcagctaa

SEQ ID NO: 91071 - DNA, 168 bp, Homo sapiens
aacattctctgccatactcctcttgtcaatttctgctcacgtctcattggtcagaattacttaacatcatgggatctaaaccactaacagctagggaatgagaccaccaggactggtttaggtcagggttctcaacctcagcaccattgacattttggactggatggt

SEQ ID NO: 91072 - DNA, 854 bp, Homo sapiens
actggatttctgaaccctatcattttggataaagggtactcaacctatggaagattaaaaaggaaggagactacataaagcatgaactgagttctggtttccaaaattatacccaggtgttggcattcaaccagtgtcatgcatactcattcagtgcatatttattaagtacttaacaaatatcacgaacagtgctctccaaatttaacctttgatctaaaggttctccctctgaagaaacttagtgaaatacagtgttattccaaaacaggagatgaaatgaagaaaaaaactcttatattcctcttaaaatttaaaaagggaacatgatggggaaataaagagtaaaacagtttgtcatacataaatatatcaaccatcacttgttttgtttaaatacttctccttaattgctcaatatggtcacacagccattataaatatttatcataatttccaccaagttttctgtgaaaaatagtaccatgaaaaattagtatatttaagctctaagcaaaaaaaaaaaaaaaaaaaattgaaacacttaaattcaataaacactgttaaaaattactttaatttggctgggagtggtggctcatgcctgtaatcccagcactttgggaggccaaggcgggtggatcatttgatggcaggagttccagaccggcctggccaatgtggtgaaaccccacctcaactaaaaatacaaaaattagctgggcatggtggtacatgcctgtaatcccagctattcaggaggctgaggcaggagaatcacttgaacccaggaggcagaggttgttgtgagccaagattgtgccagtgcactccagcctgggcaacaagagtga

SEQ ID NO: 91073 - DNA, 836 bp, Homo sapiens
actggatttctgaaccctatcattttggataaagggtactcaacctatggaagattaaaaaggaaggagactacataaagcatgaactgagttctggtttccaaaattatacccaggtgttggcattcaaccagtgtcatgcatactcattcagtgcatatttattaagtacttaacaaatatcacgaacagtgctctccaaatttaacctttgatctaaaggttctccctctgaagaaacttagtgaaatacagtgttattccaaaacaggagatgaaatgaagaaaaaaactcttatattcctcttaaaatttaaaaagggaacatgatggggaaataaagagtaaaacagtttgtcatacataaatatatcaaccatcacttgttttgtttaaatacttctccttaattgctcaatatggtcacacagccattataaatatttatcataatttccaccaagttttctgtgaaaaatagtaccatgaaaaattagtatatttaagctctaagcaaaaaaaaaaaaaaaaaaaattgaaacacttaaattcaataaacactgttaaaaattactttaatttggctgggagtggtggctcatgcctgtaatcccagcaaccaactacagaactagaatgtaaccaataatgttgaagcagctttatggtcctcccatctgtatcctcctgtcttggaaaatgtatatactttttcttcttcaaatttgggattataataaatacatctttgaatcctggactttcattatattataaccattcacccaagaaacatgttttcatactttctgtcagaaactacaaaaacctcagtg

SEQ ID NO: 91074 - DNA, 290 bp, Homo sapiens
acttgtatatacatgtaacttacaggttagttttgaagtataataataaaagaaattcctacgaacccaccaaccaactacagaactagaatgtaaccaataatgttgaagcagctttatggtcctcccatctgtatcctcctgtcttggaaaatgtatatactttttcttcttcaaatttgggattataataaatacatctttgaatcctggactttcattatattataaccattcacccaagaaacatgttttcatactttctgtcagaaactacaaaaacctcagtg

SEQ ID NO: 91075 - DNA, 334 bp, Homo sapiens
gagaagggtctatattaccttcatgtagtaggactgacatgagggtgctagatcaggtccaacaatgattagacagaataatagggtaatagtaggcatttgtttggtattgccatattccaagtactgagcaaagtgcttgctctatattatctcatgtaatcccaataataaccctttgggaaatggcatttgtattcaggcatgatgtgattctagcagagggggattaagtagggaattggtgcaaaggtataagtaggattgaaggtgcaaaaagcagagagtggtgtaactcaagagatctagctgcttttactgcctctggactgaa

SEQ ID NO: 91076 - DNA, 447 bp, Homo sapiens
atgagtatgtgtttgaggtgggggaggaagttgaagcaataagttgggccaatttcctaaagtcccttctgcccctgagattctctgcttctgtggttcaaacagaggaaatctggacatttgtccagccactatttttgtaatggaggtgggacagccagggttcctggagtgtgctgtggaatcggcatttacacttctcttccatctctagtctcatttctgtaatcttcatacagtattacagtattttgttttctaaaataccagattggcagtaagtgacaaaactagcatctcattggtcagggcttgtgggggaggaagggagaagaaagtggatttcaatgtattaacattttattggctgagaggatgtttctgaaccaattgagtaccttccccattgactgttgctggggccaagccaaaatcattggcaccacg

SEQ ID NO: 91077 - DNA, 427 bp, Homo sapiens
ttgtacattaattagaggtaaagcagagtttcaaacctacgcctgtctgacacatcttttctattacaccacactgcctccccagccatataaacttcctaggagatttgaggattcagtttaagagaatattaaaatgttctatcacatttcaagtgatagaatagtaggacttggtgattaaaaatgggagctagaagagatggaggaatgcaaggcttccactttggtcaactgagtaatatcagaactcttatgtaaaatgtataaggtaagagcaggattgagggggaagatcctgaattcaattgggaacgtgctgaaattgaatttcctgggaggtcatcaggagagctatctagtgaccattaggatacatgtaacaagagctcaagaaaaggaagagacatgaaatttcagatttcag

SEQ ID NO: 91078 - DNA, 419 bp, Homo sapiens
ctaatttccaaatattaccacttggatgtcccacaggctcttcaaaaccagcatatccaaaataaacacatcatcttcctcccaagctgttccttctcttttaacagcaccactgtagcatcctataagctaaaaaccttgaattctcctttagctcttccttttccctcatctaccttatacaactgcctatttggtgtctctgtttgcatgtcccaacagcttggccattacttcattcattcaacagatatttattgagccctactttgtgcctggcactttgctaggtgttccgtacacagcagtagacaaaactcacagcagttcagttttattcctaagagagtgatgagtatcatgatggggtcagttattgggtgatatggaaactcacataagaggtctattacctacac

SEQ ID NO: 91079 - DNA, 479 bp, Homo sapiens
tagctctgcacaataaagaagaatctggcccaaagggttagtgtggtggggctgagtacacacactgcactcatacatattcattgagcatgagtgtcaatgaataataatgtggacacatcagttttattgagttgtcaagtgtgtcgggtattgttctatgtgcctcacatgtattaattgtttgaggtgtcatcacaatcctatgaggttggtagttgctcctattatcctgtaatacagatggggaaatcagaggcccagagactctgagctccttgcccattgtgacacaggtgctgggtgttggagttgggatttgaacccaagtgcctcggactcactccatcactgtctcatgaagaacaaatggctcattctctttcttgtccctatatttgtgccattactcattagctcacacaaatgtttgctaagtgcctgttgggttctaggtgttggggatgcagcttcgaaca

SEQ ID NO: 91080 - DNA, 545 bp, Homo sapiens
tgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcgggccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttgggggaactgtcttgaaacctatacatttcagatgggcacccagagagtaagacctcacctcgcccctcaagttgcttacaatataatggaaaaaccaacaaataaataattataattcaataaacaagaaaaggtttcttctaataaacacatgag

SEQ ID NO: 91081 - DNA, 2239 bp, Homo sapiens
tgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcgggccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcataagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgca

SEQ ID NO: 91082 - DNA, 430 bp, Homo sapiens
cagtgtatctgcattagaaaatcatccatttaccctcacaatggtaagaaacatatctcttgctttttcacatttgtagggtgctatgcatatttttctttttttgtgtcctgtctcattctaaaaggtattcaaggctatcatagtactcttgatgtttaagtaagctatctttttacaaggaaaatagttatctgctcaagaactgtgtaactacactttattattttttgacaccttgcaattcaggaagtaatgaattaaaacgtattaaagcttgttgattcaaaatataggccaagcacagtgactcaggcctgtaatcccagcacttttggaggtcaaggtaggaagaccacttgagccccggatttcaagatcagcctgagaaacataaggagacactgtttctacagtaaataaaaaaaaa

SEQ ID NO: 91083 - DNA, 2402 bp, Homo sapiens
tgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcgggccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcataagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtg

SEQ ID NO: 91084 - DNA, 1443 bp, Homo sapiens
ttcatgaactttccctgaggatttcaaaccggcagagttaccagcacaaatcttcacaatatgtgctggtaaactctgccggttgaagattgtatggaagagcccagatccaagctaattccacagacttggctttggatttctggacctttgtgcctgtactgtgccgaaagactttacaggtatatccggagcaataagccagtcaccatcatttcggtcataagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtg

SEQ ID NO: 91085 - DNA, 132 bp, Homo sapiens
gtttatgtatcctttcagaaaaatatataatgatacacaagtttgtgtgtatgtatgagtgtatacagtttatacaaatcaagccgtgtgatacacactgtccaccttttattaaatatatacttggattta

SEQ ID NO: 91086 - DNA, 1923 bp, Homo sapiens
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccacagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaacatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgtta

SEQ ID NO: 91087 - DNA, 1009 bp, Homo sapiens
  misc_feature (857)..(857): n is a, c, g, or t
  misc_feature (867)..(867): n is a, c, g, or t
  misc_feature (874)..(874): n is a, c, g, or t
  misc_feature (935)..(935): n is a, c, g, or t
  misc_feature (942)..(942): n is a, c, g, or t
  misc_feature (978)..(978): n is a, c, g, or t
  misc_feature (1000)..(1000): n is a, c, g, or t
  misc_feature (1005)..(1005): n is a, c, g, or t
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccacagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaatattgtttccacagttgaatcttgggttgttaaactttgaacctaaaanaacattggcnccttccntgccccaaaaacccccaaattttaatccccaagccggtttggcttgccggttttcctgaangaataanaaaaaacccccaaacccccgggccttgaatttttcnatttcctggggaaaaaatgttnttgcnccag

SEQ ID NO: 91088 - DNA, 599 bp, Homo sapiens
gttgtgagaagatggatgttgagttgcagggtgtggcaccatttaaaggtaccaaaacaaactgatttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgtta

SEQ ID NO: 91089 - DNA, 646 bp, Homo sapiens
gtctaaataagtattttagctggctctgagtatgaataactcacttttttcctttccctagtgaagaacagtccagactggcagcaagaaaatatgctagagttgtacagaagttgggttttccagctaagttcttggacttcaagattcagaacatggtggggagctgtgatgtgaagtttcctataaggttagaaggccttgtgctcacccaccaacaatttagtaggtaagtctgaaatgtattatgattgttattggcaacagttcatttataatctaaacattgttcagaataaaacacatgcaaaatattcagtatatgagaacagttgacatggttatagttgtatgtattcttgcattgtcttcctgatgttctcagtcatatttatcaccctcaccagcctctgcttcccttatcactttgcggtacccataactcccctttactggaatgaatttgattctacttctgtatgttttatcgttttattgctgaatacacttggaatgcatgaattgaccctaacctcttgtatcaattttttttcccagtttggatcttctcttttagtcaacattgtgtcagatctaccagcaagtgtgaagttgagcgataggaacaactttctaattatcttcc

SEQ ID NO: 91090 - DNA, 436 bp, Homo sapiens
ctgaacgcctttaagtcagaatcccgcccaggcggaacgatacgaagatggatgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgtta

SEQ ID NO: 91091 - DNA, 2223 bp, Homo sapiens
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccacagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaacatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaaaaaaaaaaaatttttggggccgccggggcccgcgaaaaaagcttttctaagacaccatcgcccgttgtgggcccgcggggggcccccagatgggtaatcgtcgaacagctggtcccagagcggtgtctccagaaggaagacccggggaccagcgacacacgggccggggggttcttcccaccccaattaaaaaacgcccggggaggaaacacgagagcggttcctgctgcaaccaactcccagaatgagactgcgaagggcccacagcgggaacccaca

SEQ ID NO: 91092 - DNA, 1832 bp, Homo sapiens
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccacagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaacatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgtta

SEQ ID NO: 91093 - DNA, 1385 bp, Homo sapiens
  misc_feature (1013)..(1014): n is a, c, g, or t
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccacagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtcagactgtgcgagcannagaacacatatgcgtaagagatattgtacatgaaaggtttggggttttttcccaggctttaaggttcctttgtgggacgtttcgaaaaggatttccaggaaaattattggggttgggggggaaggcttgggttggaacttggttggaaacggcttttttcccgttaagtttaacaggggcgtctaagggaaaaaggggggcgcctttttggggttgggcccttcctaaagcgccacctaaagccccaaaaatcccattctttttaaaggggtttcaagtgggttttacaaggggtttccccttggggaagaatcctgggggtcacattttttggggggtggggcttatcgggggttataccctttttccgg

SEQ ID NO: 91094 - DNA, 1633 bp, Homo sapiens
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccacagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagaggtagccgtaagaaattcattcttctggtctatgggttatgaatgaaaaggtgatatctcattgtttttaggttattaggttagcactttaacatgttattattgctttcttataaaaaccattttaatatgattctattaattatttttatttatttatttattatttgattctattaatgttagatagcagtgatttcattttcttaaaaattagatatgggcaggcgtggtgtctcaccaaggcgggcaaatcactcgaactcttgacctcaggtgagctatccgccttggcctcccaaagtgcttgggattagaggcgtgagccaccatgcctggcccacattctgcttttcttatgtaagctctgaactgctaagtcgtagtttattcaacaaatgacataggaatgtctattcatgatgagtcttggtataaaagaggatagaattagtgaatacattgttcaataataaatctcatcaacattttctgatcaaaatgaagtttgttagttttcctctcagtagaaatgcatgggctaaaatacagaaatagtgatgactgatgatggtgataattcacatccataaaatctagggctacaataatttggcggattgaaaggtcattttggcaggcctacag

SEQ ID NO: 91095 - DNA, 480 bp, Homo sapiens
cagaacaacagcctgccaccttacgctcagggcttggcctcccctcaggtaatatagcaggagggagagaatagggagggcggaaatctgaactgcaagagatggtatcaaaaggcaaggaagggcatttaatgatctgtttttgaaaatggtttaatatgttttttaagccttattttgttgagaagttctattaggctttgaataggcacaatggtgtttatttgggaagtctggaagctaagttatatatttatgaaacacctaatcttttgataaacacttatgagaatgttccaaatgactatatagggtctttgattttgaaaatcaccctcaccaaattattttctagttttatttttccccttttacatttcaagctctcaaccacccatctactttaaaaatttttcagcctgggtgcagtggctcacgcctgtaatcccagcactttgggaggccaaggtgggcggatca

SEQ ID NO: 91096 - DNA, 346 bp, Homo sapiens
cgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtg

SEQ ID NO: 91097 - DNA, 494 bp, Homo sapiens
gttttataaacaaaaataagattgtgacaagggattccactattaatgttttcatgcctgtgccttaatctgactgggtatggtgagaattgtgcttgcagctttaaggtaagaattttaccatcttaatatgttaagaagtgccatttcagtctctcatctctactccaacttgtcttcttaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtg

SEQ ID NO: 91098 - DNA, 1866 bp, Homo sapiens
cgccgttccggcctgtaacggccactcggccgccactcccgcctggtgccctactctgctgtgtttcgcaggcagcttcccatcgtacgattgtggggctcaggcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaacatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgtta

SEQ ID NO: 91099 - DNA, 1459 bp, Homo sapiens
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccacagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaacatggtggggagctgtgatgtgaagtttcctataaggttagaaggccttgtgctcacccaccaacaatttagtagttatgagccagagttatttcctggtttaatctacagaatgatcaaacccagaattgttctccttatttggtctggaaaggtgtcttaccggtgtaagtcgagcgcaattttgagctttgaacatttcctatttaagggtacggcagagacgatgggtctggtcctgttcccacccctttttttttttacacccctgtgggggcccagggggtgcccaacacttgtgggggcacgagctctctattccgggacagggatttgcaacacccgtgttacgcgcggcgccaaaaaagagggggagactg

SEQ ID NO: 91100 - DNA, 1571 bp, Homo sapiens
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccacagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaacatggtggggagctgtgatgtgaagtttcctataaggttagaaggccttgtgctcacccaccaacaatttagtaggtaagtctgaaatgtattatgattgttattggcaacagttcatttataatctaaacattgttcagaataaaacacatgcaaaatattcagtatatgagaacagttgacatggttatagttgtatgtattcttgcattgtcttcctgatgttctcagtcatatttatcaccctcaccagcctctgcttcccttatcactttgcggtacccataactcccctttactggaatgaatttgattctacttctgtatgttttatcgttttattgctgaatacacttggaatgcatgaattgaccctaacctcttgtatcaattttttttcccagtttggatcttctcttttagtcaacattgtgtcagatctaccagcaagtgtgaagttgagcgataggaacaactttctaattatcttcc

SEQ ID NO: 91101 - DNA, 144 bp, Homo sapiens
agtgagagctgggaaatgacagcatagagcagagatgtgggtacatgaatgagacagagaccttcctacgtgtgccctttactctcccaactttgtcctgtaagtaccgatgccacagcagccccagctggaggccagttacca

SEQ ID NO: 91102 - DNA, 373 bp, Homo sapiens
gttggtgtctgttttgggagccaaagaaatggaggctcagaggtaaaaagcctgttgtcaagtcccagtgctagtcactgacgacagaactaggacttaaaaccagttctcagttattcagacctgaccatggtggatgctgtggatacagagtttgaaaaacaaaagcacctgccctcttggagcctcagggaaagcctcagaatcccagcttctcacaggcgtgtccaggctagcagaatcctgtcacctacgagagaccacaccaaccttggaagtttatgagaatgtgcttaaactgtctctcacttcactccgattgttacatctattttttttctttattgaaatgccatcacattttaaatacatt

SEQ ID NO: 91103 - DNA, 292 bp, Homo sapiens
ctcatcacagactgcagctgctgtccatgtggcctccaactggagagactattttgttgaacaaagagatcagcctgctctgggtatctctgtcagtctaggtctccccacaacatgaggggcagtcattaccatggttactatagagcttctagagcagtagctattaaccagggctgcagattagaattttctgtgaagcttcacaaatggctaggcctctccctagagattccaatttactgggtctggaagggcttgtgctcttctccaacctccttaagatctttga

SEQ ID NO: 91104 - DNA, 475 bp, Homo sapiens
atattgcaggacattttcttagttcagctaaagatggggtccttatcacagggccacaaaaaattaggctcacagacaatttgaagggtaaggcaggtttttattgggtgaaagagaaaaaaaagggaaatggggatcctccgcaaagccagagtgcctgctggtgagcttcctgcctcgaagtttgaatcccaggtaccaccgaggaagaggagggaccaggctcctccccactgcaaatggcacaaacttccgtggcatcaccccagtttgcattcttctcagtgcacaagctagttggagtttccctggggacccctttccacctggctgtctcaatgtcttagtgaaattttagaatactaaaaataaagatcttaaaaacaatcataggtatgaaataaaaattaggtatgtaacaaagtttccacgagtagcaattggaatccaactgaatatctttaaagctctaggg

SEQ ID NO: 91105 - DNA, 367 bp, Homo sapiens
tgaatagtggggtgggctggatcagctcagtggtcccttccatctggataatttcatggttgtataactttgtcaactagagaagcagagttctggtgctcctttggataatatatgcctctcgctttaactgccttcaatgtggtccttctttcaattctgctctccttctttggtgccattgcacagctaaaagggctgttttgaattggaactaagcgaacaaagttctttctggctgtgtctttggcctcctgcaaagcctcaggcatctaagatgtcaggagctggctgccctgctctctatcccagagctggaggaccaggactgggcaaagacattgctcccagtctccttgcagcatca

SEQ ID NO: 91106 - DNA, 379 bp, Homo sapiens
attcagaacccttgtttttttcctaccagggaggggcaccccatcaggctgagcagcttccctggaaaccctctgtacgtgctcatcccagtgcctggtatcatgccttggtgaagccccttatacagttagtagtggcgtcaagagcaggtttgggtaagggagggggacactgaggtttgcaggtacttcctctggcacccactgggatgatttctctagaatccatgtcatgcactatcaccaaaacttaagatctggtgtacagtgggtaaattctaatgatgccccacccctctccgctctggaatctcatggaagataatctagatctgtggtcagaagagggctcagggctcaactctgtcccttccaagtc

SEQ ID NO: 91107 - DNA, 475 bp, Homo sapiens
gaatctggataaattccctttcacttctcccctgggcgtgtgtgtaccagggtgactcacagatctgacttggacctttttttgtgctttctgcattcctggcagcctgggcctgggatttgctctgccaccctgggtgacatgaagctctcagctctggcggctaaaaggctacactgttgtggggctgggacaccctgactcttctccccagtcattgttttctgtttctgtgtcatctcccccagctcggctcctcctgtgtcactgctggtcttccaagatggtggaagacactgtggtttgtctctttgcagtctcgctctgtcgccaaggctgtagtgcagtggcatgatcttggctctgcagcctctgcctcccaggagaatctcttgaccctgggaggcggaggttgcagtgagcagagatcacaccactgcgctccaacctgggtgacagaatgagactctgtctc

SEQ ID NO: 91108 - DNA, 665 bp, Homo sapiens
  misc_feature (404)..(404): n is a, c, g, or t
  misc_feature (630)..(630): n is a, c, g, or t
ctcaggaacctatctgcacttatattagtcacttgttataaaaactgttgttaagactgaggctctaaaggtttctggtgatttgtcttcagtgacacgtgcatttttgagctgtggcatttaggtctcctgactcatattgagttgcccaatattaaaaacataactcaaaaggtccaaaggaacttcctttacatacatccacattcattcccacatcccctaatacacatgcattcatacaccaaaaatattttctactcacttgaaggaaataattactatggtgggaaacaaagtccattattcttcaattagaaaacaaaacaaaacaaaacaaaaacaaacttagaatagtttgaatgaggtaaatacattggcaaattaattcacactaatgtgtnaatgactaccacttgagtattttctaataatgggatttgccaaaaggatcctggggccgtttagtggagaaaagttttaccaacaagtcactgaagatgctgaaaagcaaacatccccacattgcactgtacaacaaatgaactcccaccaggggtctcagaatgcagcctgctgttttcaggacctctgagccacatttccttgggccacatctatacttgcctngtactggcagagaactacaagagaacctattgaca

SEQ ID NO: 91109 - DNA, 1379 bp, Homo sapiens
atttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagagagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtgtggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggttaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaaaaaaaaggag

SEQ ID NO: 91110 - DNA, 291 bp, Homo sapiens
atggtgcacacctgtagtcccagctactcaggaggctgaggtaggaggatcacttgaacctgggaggtcaaggctgcagtgagctatcatcctgctgccctgcactccagcctgggtgacaaacgagaccctggctcaaaaacaaaaaaaaagattaaaaatagcacccttttacaatgttttgtgaaggtaaactagctgactgttgttcttaagaatagctcatatggaaaatttctaagttggaaacatcttcagaactacacctctacccaaccccaccccctcaaa

SEQ ID NO: 91111 - DNA, 98 bp, Homo sapiens
tagttttctgtttacaaaagacaagatccataacatcacccaacaaccagggtccaagtaaacttcttaccataataactatcttaaacgtcaaattc

SEQ ID NO: 91112 - DNA, 389 bp, Homo sapiens
gaaacccttgctcataacaggaattgatgagttgatagaaatgtttatgagtaccttattctggtgttactgattttttccatactactctataacaaagtttttcctggtaaagtctataaagtttatttgtgctttaatacctgaaagaccttgagaactgactcagaataaaatagagcaagaagaaaagccttttcagataaaatcacaaaggaaccttaatgtccatatggatgggttcccaaggcattagcactcaggcttatatagcaaatagaaaaaaatattttccattcacctggtttctattgaataaataactcctccattatgtcagatcaacttaggaatggactaactaatagatttgttatttcatcaaataa

SEQ ID NO: 91113 - DNA, 288 bp, Homo sapiens
acacaatttacatatcctgaaattcacaaattataactgtgtaattcaataatgtttggtaaatttataaagttctatagccatcactacaatccagttttagaacatttccattactccaaaaaaagttgttttgtgccagttcacaaataatccccaatcccacccctagcttgaggtaaccactgatctgctgtctttagagatttgccttttctggtcattttatatgcatagaattatataagatacagtcttctgcatctggcttccttcacttagcacagg

SEQ ID NO: 91114 - DNA, 492 bp, Homo sapiens
tttctagagacattctttctgaatttcaatatcttataaattaaatccctctcttattttttctgttaacaacttacttttttccttcatagcacttatctatgtaataatttttatcccacctggtaaatgccaatggggtagtgatatggttaggctttgtgtccccactcaaatttcatcttgaattgtaatccccataatcgccatgtgccaaggaagagacttagtgggaggtgattggatcatgaaaacagtgccccccatactgttctcatgatagtgagtgaatttgcatgagatctgatggttttataaaagtgtctgacagttcctttttcacacacttgcttgctctgaaatacctgccgccacataagacatgtctcttcctctaccgccatgattgtaaactcccagaggccttcgcagccatgtggaaatgtggaactgtgagtcagttagacttcttttctccgttttttttttttt

SEQ ID NO: 91115 - DNA, 379 bp, Homo sapiens
tttcaccatgttggccaggctggtctcgaactcctgatctcaggtgatccacctgcctcagccttccaaagtactgggattacaggcgtgagccacccacttgacctgaaaccctgatagtctttactttgaattgcaaatatcaatagaaacttgggacagagttttttgttttgttttgttttgtttaaagaaaaaaaaaatcctaactctggacactttaaacaggcctagaagcaatcacaatccagtagcaattaatgtccatccctgagtgtggtctctaaatattaggactcaggagagatggcggattgtaacactgaagcagaaacgatcaagacaagcctggaatactttgtaatgcctgaaagcaata

SEQ ID NO: 91116 - DNA, 242 bp, Homo sapiens
aggctgcaggcaggagggaccacccacggtgaggaatcaggaggcacagagcctacctgaggggaggctgagcaccaggcaccccggtgtgggaagatggggtgaagctacaccacccaagcagtgggaccccacagacgggaacaggccagggggcaggacccacccaaaccacccagagtctgagctagagagactggctttgatgctgcctcccctcccctctcctccttcgcctccac

SEQ ID NO: 91117 - DNA, 183 bp, Homo sapiens
aagtggggagctccaggtcactgtccaccaactccgtgctgggcaccgcaccagaagctgcacattcaccttctcgcttggatctcagaagcttcattatctccagggctcctgggcacctagcgggggctaatgaagctgggttgagcaggttctgtacacctgcacaggtatcttttctcc

SEQ ID NO: 91118 - DNA, 643 bp, Homo sapiens
aaggaattcaagctccaaagagagcagggagaacacagactggagccagggagaagcgaagaagggctgggaactggcatgagcactccaggcactctgttgggcaattatggtatctcatttattctcacaaccccacgagacaggggctgttatccctgttttacaaatgaaagagcggctcagtttatcaagctggtcagtgatgaggcaaagatgaaaatccaggtctaggcaaccccaaagcccttgctgggtcatgagccccgagacaatgtgctgtgtcacagcactgtcatttagccacccaggaggagcggaaatgtctctcctgagggtccaaatcaacacggtcaaggctaacagggatcaatgcaaagtcctgattgtcaggaagtcatctgcacaagtgcagaatggagtcctggcgaatggacagcagaccatcatgatattgtcatcatgcgactgtcactgccgctctctttccactttgcagtttataaagttccttcacggctgggcacggtggctcacgcctgtaatcccagcactttgggaggccgaggagggcggatcacaaggtcaggagttcaagaccagtctggccaagatggtgaaacccagtctccactaaaaatgc

SEQ ID NO: 91119 - DNA, 291 bp, Homo sapiens
aagagctcttgagtcaaccttaaggagtggatgcaaaaagtgagattggtttgtgatgtgaaagaaagggatatggaaggttcaggagatctcatattgaggggacttgccaggctacctttgtctttaagtaagtgttgggtgagactaccatcaaagatcgttactgcctttactgcatgaatataccacttgtgtttacattgtttatgctggtgcgtgtgtgtttgcatccgcacgtgcgtgcagcatgcttgtagttcaattcacgtgtccagcaagccatatact

SEQ ID NO: 91120 - DNA, 395 bp, Homo sapiens
ctaccatgtcaaaacataggatatttccattatcccaaaaagttccctcctgcccctctgcagtcaaacacttccctcccccagctcctggcaactgctgatctgaactgtagacctgaaaatgtcattcagaacccatttcatctggacccttctctctgtgtcaacattgctgtgagcggtgtctgtgggatttttctggacgttctctgccatgcccctgctccttccttcctgccttctggaaggcacccctgccaggagtcggctgcattaaagtgggtgtttcaggggtgtcttcctttactctcttctcactgatttccagctatccctgtgtctcttgtttaatgagtgccttcacccatatccttaaacccaccagggcgaccttc

SEQ ID NO: 91121 - DNA, 442 bp, Homo sapiens
gggttcacgccattctcctgcctcagcctcccgagtagctgggactacaggcgcccatcaccacgcccggctaatttttttttatatttagtagagacagggtttcaccgtgttagccaggatggtctcgatctcctgacctcgtgatccacccgcctcagcctcccacagtgctgggattacaggcatgagccactgcgccgggccaaataagtgaatgttttaaaaaacagcatcagagatctgtgggacaatatcaaacaggcaaacaagcacataattgaagtcccagaaatagaggacagaatgggcaaaagaatatttgaagagataataattggacattttctaaaaatgaagaaatacatcaacccacaaattcaaaaagctcagcaaatcccaaacagtataaatattgaaataggttgggtgcagtggctca

SEQ ID NO: 91122 - DNA, 453 bp, Homo sapiens
tagtagagactgggttttgccgtgttggccaggctggtctcgaaatactgacctcaggtgatccacttgccttgtcctcccaaagtgctgggattacaggtgtgagccactgcgcccagccctaagcctccagtttttgacctcagcatggtgaggaagtagtagaagtatgtattttgggtgaagaggagagtaaaagcatgctcccatttatatgctaacgctgtgctttttaaaaatgtggttacttcaacttttgtaatcttttcattgaaaacatttggttattctgctaacctttgactattctctttaaaaatgtcctacattcattccatattttaaagttttctaataaacctgagttcccacttgttttttttccttccagcttttattttaggttcaggggttacatgcacagatttgttaacatgggcacattgcgtgtcg

SEQ ID NO: 91123 - DNA, 871 bp, Homo sapiens
ggtgaaataagatgttcccagacaaataaaaggaaaactcaatagtagtgacttgcattataagaaataaaaaggtaatttttcagtcaaaaagcaagtgacaccagacagtgattcaaatccacgtgaaaaaaaaataggaagcaccagtaatggcaatcatgtgagtactttaaaaagacaattgcatgcttcttttcctttcttctcttaactgacttataaagcaactgcataaaacaatctgtatattattattttattgggaatgaaacaaagctatgtaaggaatgataccaggtaatatcttgaatccacaggcatgaatgacgacagccagaaatggtatctaagaaggctaatatcacgaactctctgcatatatatgtgtccttctctcagctttttaaaaaggcaaggtcatataaagatgataatgtattggtttgtaacatatatagacataatatgaataacaatagcacaaaactgggatggaaagctatataatagtaaaatttctatatttcactgcaactaatccgtacaaatatgaagtaaattctggtaagttacaatgtatattgtaatccctagaacaatcactaagaaagttacttttaaaaataaactttttttcaacatttattttagaatcggggtacatgtggaggtttattacaaaggtatattgtgtgatgctaaggtttggactacaagtgaatttgtcacccaggtagtcagcatagtactcaataggtagtcctttataaccttcaccccttctccctcccttctcttgtattctgcagcatctgttcccatttttataaccatatgtaccccagtgttgagctcccacttatgagaa

SEQ ID NO: 91124 - DNA, 269 bp, Homo sapiens
gtgttgttatccatacatggaatggggaggttaggaatcttgaggtctttggctgcatgattcctgagccatgatttctaatcttgtggctaatttgttggctttacaaagacaatctggtccccaagcaaggaaggctttgtttcagggaggggctatcatttttgtttcaaaattaaactatcaactcaattcttctcaaagttagtttactctacaccctggagaataaagaaggcctggagctgctgaagactgctattgggaaa

SEQ ID NO: 91125 - DNA, 257 bp, Homo sapiens
cagagtagctcaaaaatttgtatggaaattttttccatcatcctctctttccaacaatgcaagcctgagcagcttgtctctggtggatggcagaagttcaataaccacaaccttatccaactactaatgtgtacagaagagcaggtcattaagagggttggctactaaaataacccctttcttccagtagcctacattactataatgattccttaatagcaaaccatttattaagaaatgacacaaagactacattc

SEQ ID NO: 91126 - DNA, 690 bp, Homo sapiens
aattaaaaataaaagaaaatcaagtaacttgctccaagttcacactgctggagagtgagggtgttaggattcaagcccacagggcctcattcaagcaacacatgtaatcaacatgtatgaatcacgtgatgtttcccaggcactgtggtcccacaaaatcataagtgtcttcacagtctttccatgttgctattactatctaaattgtcttcaagatggtaagtcccctccccactgtaacgcaaccatgtgacagcttgcgtttgaaatcaggtctgcatgacctccaactccatactccaaggccaaagttcttgatctggagagttttctagagatgagaagcaaagggaatgtggaacattttttaaaaatctgctgcagttcttcatcatcttgggtcaggaggcagcagggtagtggtggtggggacatgatgatctcacttgcaagttctgtttaaaatccttatccagttctgtttcagtgtgttttcatactccagggtaggtgaaattctagaaagtccaagatctttccaaaaacagttcggatctggaccatgcttatgagggacccatgattactaaataaaggtaacccattagcatgggttaatccagcagtattttgccctggttgtgcagctagctagttgtgtcacagggcagtctcgaccaggcctccagc

SEQ ID NO: 91127 - DNA, 482 bp, Homo sapiens
ttccataggaacttgtttatatcagttagcctatagtaatactggttttgttatgcattgtcttgcttaaagtctcagtttctaagagcctgtcaacaacattaagaacttactatatatcagtaatcgctttgaacagcaacgataaatgcaccaattaaaagacagagattgtcagagtggatgaaaaaaacaagacccaaccataggatgtctacaagaaatctactttaaatataagacatataaattaaaagtaaatgggtggagaaaaatataccctgttaacactaatcaaaagaaagcagaagtagctatattaatttcaaacacaattgacttcaaaaaggaaagttatcagtgataaaggcattacataatgataaaggagttaattgtccaagaaggtgtaataatccttaacacatgtgcacctaacaagagcatcaaactaggtgagacaaaactgatagagctgcaag

SEQ ID NO: 91128 - DNA, 371 bp, Homo sapiens
ccgatggtgatctgtgggtgtcatgtgtgtgcacacagatgaccctgtacactgacttgcatgcgtgcaccagcgagtgtggattacttgcctgttctgggggtgtacatgtgtgtatttcatcatttaggcttgccaaggcagagggcagggattgcttaatcagaaactccactagaacttaaggagtggcctgtggtgctgatgcctgcatggcctcagcccctgatttccccaacttaggcaagtgtgaggctgggaccaccagttgggattactgaggaagggatgttcaaggtgctctgagattattgcctggcacacaggactgttaaatgcttgcacgtactttcaagtcttaagtagtttgg

SEQ ID NO: 91129 - DNA, 419 bp, Homo sapiens
cataggtgccagacaaatattatctaccattgttatacttatcactattattcttacttgaagaactatgtagaaaataattattgaaatccatgcaacaacatttagcatacttattaaatgcaaactgtgtgaagcattgttcaagattctggagtctatattttaggtaagaagctagacaataaagaaataaataataaatgggaaatttttatatacttgtaagtactcttgaaaattaaatagggaaatatgaaagagagcagctagggaatgaaagaagggaataaagatttttcattttttgtaacactagatggtatgcttaagtaagatcataactaagaagtgaatgataaaaaggagtcaggcttacaaagatttcagggaagaggatttcagacaagggaacatag

SEQ ID NO: 91130 - DNA, 123 bp, Homo sapiens
gagattgtgccactggactccagcctgggcgacagagagagacttcgtctccaaaaaaagaaagtccaaatacatgcaaataaaacttggcataacagtcttgcccaagccattgcactccgg

SEQ ID NO: 91131 - DNA, 311 bp, Homo sapiens
actttcatatgaaatagagaaacaatttaggcaacatttggcctaaatcctttggatgaatgtctgaattccttaaaattagcaattagttcaaacagttctgctttcagtatcagtatattttaaatctacattttttctggcctcaatggtccaaataactttacacctgccatgcaattacctcccatttgtagaaactttaccactggcaaagcactcccatgtacattgtctctgagtccatataatcagaagtgggcatggaccagtcacacattggttcctgaacaccagcttgtgaacagatc

SEQ ID NO: 91132 - DNA, 428 bp, Homo sapiens
agaaactccttagtcctctgaaacccggtacagtttgtcactctagctgcagactcgcaaggtgtccagagagcactgccatctcctagatcatcattaaaacaatatgtattaagttcttcttgagccaggcacatttctcagcaccgggggggacctacgcaccagagataagaaaaaaggagagtaaaattgtgctgaatgttattgcagagcactgaagagagaactagaccatgaacggaggacagaaatgatggagagtggggaggagcggcctcatggagaaagcaccacttgcccaacgatctggaggagacgagtgaatgaatcatgccagtatagacagggtgggtgggggttccaggtagatgaaaacacaatgcagttggcaagaggctgtacagaaaatattccaaataggttct

SEQ ID NO: 91133 - DNA, 845 bp, Homo sapiens
ccttaggaagagttaatggttatagaggctacagaaagcatttttattgtatcatcttttgtaattataaccacagcacttatcactagggcctcagccagatcatacaaatagctatgttgcaaatatactagagtagtggcatatgagtcagtatttattcttgaaaactgaaaagcctagtttcattaacctactattaaactgatgtgtacactgctgtggtgaggaggtggcacagttgccttttctcctccatttcttttaatttttttgtttgtttgttttagaagatgaagtctcactctgttgcccaggctgagtgcagtggcacttcatatagctcactatatatagctcactgtagtgagctatatagtcccaaatagctgggactacaggcacacgccaccatgccttgctgatcttttaattttttgtagagatggggtcttgctttattgtccaggttggtgtgaaactcctggctttaagcgatcctcctgccttggcctcctgaagtgctgggattacaggcatgaatcatttcgcctggcctcttttcctccatttctaacactgcttctgctaagttgtgttttctctaatatatacattgaccgtgacctctgtataatatggaaacagtaacaaaagcaccaaaataatccaaataagtaaagggtgaatgcattgttacttgtgcttttcaacagggacaagattaacagcttgtattcattttataaaatactactttaaaaagaaattgaaactagtgttaggaagaaaaagactacattgccttttaatacatggccaaaaacaccttccatcacagtctt

SEQ ID NO: 91134 - DNA, 465 bp, Homo sapiens
aagaaataaaactgtctttgtctgcaaatgacataactgccaatgtggaaaatctgaaataatcaacaaaaaattatccttgaattaaataattatagcaaggttgaaggataaaaggcaaatacacaaaagtcaattagtttcctttataccagccatgaaaaagtgaattctgaaatttaaaatgtgttaccttacattaacacccacccaagatgaaatacttagtataaatctaacaatatagttataaaatctatatgagttaaactttgatgaaagatatccaaaaagaactaaataattggatagatattccatggttatgtacaggaagactcaatagtgacagatttcagttcttcccagcttgatgtatagattcaacacaatctcagtcaaaatcctgcgagttattttgtgggtacagacaaactaattctgaagtttatatagagaggcaaa

SEQ ID NO: 91135 - DNA, 473 bp, Homo sapiens
gacaaagcacatcacagagctacacttaactctgaagagacagggaagttcatcctaccatgtacccagaatgtggagaactggaatatttgatgaacaatactaatgaccaccaaaagccttgtcctttgctaatcattaaaaaaaaattgcccaccaattctaacgacatcttggaacaattaagtccaggcttggcttaacattctgtcctggaggaaaacccttccatctaaaacccctcttgcccacatcctgaagccagctcgccctgaatcatgggaccctggagacgaggagaacagaggagagcaaggtcagggagatggctggtggattccaccggtgaccatgggcagagctctgaattctgaattgtattagcccacagagtaactatgcatctgtgttgtggggtagtggaaaggccatctgactcctgtgtgaccttggacaagtcatctggaaagatc

SEQ ID NO: 91136 - DNA, 344 bp, Homo sapiens
aaatcagaaagaaaataggaacattattactgattctgtgaaaataaaaaagattataagagaattctatgagcaatatatgccaacaaattagacaacctagataaaattcctagataaaaacctagataaaaaaacctagaaacacaaaacttaccaagactgtatcacagagagttagacaatcaaaaaacacttatggttattaaggaaattgaatcagtaatccaaatctctcaacaaagaaatgtccttgacttgatggcttcactggtgagttctaccaaacatttaaagaactaataccaatccttctcaaactcttccagaaaattgaagaggag

SEQ ID NO: 91137 - DNA, 413 bp, Homo sapiens
catacacacagatctatgaaccgagacttgcacacactgcctctgctgtccactgacctggttgtttagcccagggatctagggccaccaacatgcacatgtgatggaggctactagaacctgtcctagagaaggacgggactcatcgcgcctttccttaaggggcggggcagggggtgcagagaatgtggcttaaggaccatcacattttagaaatgtttcagaattatagagcggtatttgtgtcactttttgggtggggtgtgaatgtaaagtggtcctctacaggtgtcttccagaaagcattgaggctgttcatgtgaacctttgtgcttttgctgctaaactagaagcatagttttggattggtttattgttttgtcttctatgaatagaaaaaaataatcaaaact

SEQ ID NO: 91138 - DNA, 320 bp, Homo sapiens
gtaagtgggcccacgtcacacactggccccagtgatcgtagtgttgtaggaagcgctgccatatttgattgaatttagccattctggaatgacgtgttcatgaagtcggctcttgcattaccgtggcctttattattgctaatgcattctgacattacaggtgtagccttggctctcccagaaagggcaaggctgctcttaccaaacgaaagagcagaatttatgaaactgttacacagtgaggccagtgttcacctttagttactaagcagagtaagggaaataaatgcttttatagaaaagatagccagtgacagcag

SEQ ID NO: 91139 - DNA, 248 bp, Homo sapiens
gaacattccatcctgtttttattagtatattcttgaaatatagtttgaaattataaagtatgatgtccctctgctttgtttttttttctcataattaatttggctattcgaagtttattgtagttttttgtaaattttaaaatcgtagttttcattactataagaaaaaaatgccactggaattttgataggtcgtttgctgaatctatagattactttggagaatatggtactttaacagtatttat

SEQ ID NO: 91140 - DNA, 292 bp, Homo sapiens
tagagaggggtgggcttaaacagatgtttgggtctggaagctaaaatcagcttttggtgtaggagtcctttctttctttctttctttctttctttctttctttctttctttctttctttctttctttctttcttccttccttccttccttccttccttccttcctttctttctttctctctctcccttccttccttccctccctctctctctcgttcgttctttctttctattttttttttagacagggtctcgctctgttgcccaggctggagtgcagtggcacaatcttg

SEQ ID NO: 91141 - DNA, 471 bp, Homo sapiens
ataaaaccttcccatacataagtcagcaagatcattcagttttttcttgtgaactttaaaaaatggtaaaggcagtgtatagaggaaaggcatcttggcattcaaattcatgagcccccttcagcaatacttatggcactcagtttaggaatcaattactagctgtattatagagatatcaagaatttaatcacttctccctgagtattgcttatttaagcagcccacccacttacctatctttgtaggagtatacttctgttataaggtactgtgtaagcacagaagtaaataacaatggtgaataaagaaatacaaaaattagctgggcatggtagcatgcgcctatagtcccagctactcgggaggctaaggcaggagaattgcttcaacccgggaggcagaggttacagtgagcagagatcatgccactgcaccccagcctggtcaacagagcaagactctgtctca

SEQ ID NO: 91142 - DNA, 454 bp, Homo sapiens
ataaaaccttcccatacataagtcagcaagatcattcagttttttcttgtgaactttaaaaaatggtaaaggcagtgtatagaggaaaggcatcttggcattcaaattcatgagcccccttcagcaatacttatggcactcagtttaggaatcaattactagctgtattatagagatatcaagaatttaatcacttctccctgagtattgcttatttaagcagcccacccacttacctatctttgtaggagtatacttctgttataaggtactgtgtaagcacagaagtaaataacaatggtgaataaagaaatatatgttgggttattttaatttaattgaaagcagatgtcaaatgatacccgtcaatacttattaaaataagacagttaaacccctgtgaacctcagcaactcaaaatttgcagttcagtcatagtatacatggatttcat

SEQ ID NO: 91143 - DNA, 344 bp, Homo sapiens
  misc_feature (85)..(85): n is a, c, g, or t
tatccccggctctgggtaatgaaataatctgtacaacaaaccctgtgacacaagtttactacataacaaactgcacatatacccnccaacttaaaataaacgttttttaaaaaagaaaatcctgcttcaaactaaccgaatttaagaattgttggctgggtacggtggctcacgcctgtaatcccagcactttgggaggccgagatgggcagatcacttaaggtcaggagttcgagaccagcctgcccaacatggtgaaacactgtctctactaaagatacaaaaaattagccgagggtggtggcgtacgcctgtaatcccagctactcgggaggctgaggcag

SEQ ID NO: 91144 - DNA, 317 bp, Homo sapiens
ggcagggggagaaaagagacttttacttgttttcccccagcagtcccggaataagcaaaccatggccaccggccctttgtgctcagaggctcaaggcagcaaggggctgaatggggcacatgggccggggctcgggggtcaggctcaggtgtggctctgctgggacggcagcatcgcattccgccgggctgcgcggccagtgggccaggagcccgatccacagctagactctggcagctggcaagcagggcgtctcctgggccagcacgccgtctgaagtgttgccttcttgggccaggctggttttcaggggctgg

SEQ ID NO: 91145 - DNA, 475 bp, Homo sapiens
aaagaccttgctgataaaacaggctatggtaaagaagctggccaaagcccacaaaaaccaagatggtgatgaaagtgacctcccattgtcctcattgctcattaggcactaattataatatattagcatgctaaaaggcactcccaccagcgccatgactatttataaatgccatggcaacatcaggaagttaccatatatggtctaaaaaagggaggaaccctcagttcagggaattgcccaccccttccctggaaaactcatgaataatccatcccttgtttagcatatggtcaagaaataactgtaagtatattcagtcaagcagcccaggctgctgttctgcctatggagtagccattctttattcctttactttctcaataaacttactttcactttatggactcgccccaaattctttcttgtgtaaggtccaatgaactttctcatgggatctggattgggacccctt

SEQ ID NO: 91146 - DNA, 122 bp, Homo sapiens
tggcaggctgaggctgtgcgtttccatggagttcctgttttgacctgatggaaaatctctgtgggccaccatgtgcctggccagggcagcggaggggccggagatttgcctggatctgtggc

SEQ ID NO: 91147 - DNA, 476 bp, Homo sapiens
gctctagaggtccacctcataatgggagcccaaagacatacacttggctaaaacatcgaagagtagcgaagaaaggggccgtgaatgaccttctagaggtgaaacttgagctgatatgtagagaactaagcctgtaaatctgccttatcccccactttctctgctcccaatccttcctaaactgagaaaccctggcctaatgcaaccttagctgtcttcttctctgtaggttgctctgatccacttgcaaaacgtttcctaatccttttaagatgacctacccaccaggtcttgccttcttcccttttatgatctttaacaatattgactaaatggaaatattgcattatttattatttctgtcaggatttagatgatgtgccgcttttccccttatggtaagaaagaaatctccctacctccactaaatgcttaaccttctagattgaagattcgtgattgtgactcttcctgag

SEQ ID NO: 91148 - DNA, 441 bp, Homo sapiens
ggctgagacagtgcgggaacatttagggttaactgtaattcactgccaagaaaaaacaatctgtccagggagagcccaggtcatgaaaaagatggaaaggaaggcccacggaagtggaagacaggatgccaactctggcagagtctggccctcaaaacagtgcgtaaatttcctttcttttcttttcttgtttttctttttttgagacagagtctcgctctgccatctaggctgaagtgcagtagcgcgatctcggctcactgtaacctctgcctcctaggttcaagtgattcttgtgccttagcctcccaagtagctgggactacaggcccgtgccaccacacccagctaatttttgtatgttttagtagggatggagtttcaccatgttagccaggctacgtgatccgcccacttcaccttcccaagatgctgggatta

SEQ ID NO: 91149 - DNA, 296 bp, Homo sapiens
attcaatttggggcaattacttgtaggtgttctttaaagcaaagatgatgccagaatgtaattgaattttgaaatagcagtatccaaatcagttaaaaagctacttcgtcatgcatgcaaggctgatctcaatctgttgtcattagaggaaggtggtgaccctttcttcccacagcaagttgggtttttgttgcctcatatactgcaagcagtcagctactttttttgagtgttttcaatatggaaacaaataatagaatttagttctggtagaagtcacttatttgttatctttt

SEQ ID NO: 91150 - DNA, 443 bp, Homo sapiens
tgtcacactacctatatttcaaatactcggtagcctctggttgctagtgcctgcggtattggatggcacagacttggggattcgtccaagtagcagagctgggatctgaagctaacaaagttggttccagaatccaggatctaactaataactatcctggctgggcgtggtggctcacacctgtaatcccagcactttgggaggccaaggtgagcagatcacctgaggtcaggagttcaagaccagcctggccaacatggcaaaaccccgtctctactaaaaatgcaaagattagccggctgtggtcgtgggtacctgtagtcccagctacttgagaggctgaggcaggagaatcgcttgaacccgggaggcagaggttgccaagagctgcgatcgcgccactgcactccagtcagggtgacagagcgagactctgtctcgaa

SEQ ID NO: 91151 - DNA, 258 bp, Homo sapiens
agatcctgggcacagaagaacgaggctttgtttcttcccaagcacgactctttactgttctctccgtactcagaacacagtaatcagggatggaggagctaagctagtgaaagtgtttttcgtgaacatgtggaacctataacatactgtggtcaaagggctgtaccatggtctgtctccgaagggagtgggaggtccccaagattacacaccgtctgtagcctcgcctgagctatatgtatttctctacttgccctt

SEQ ID NO: 91152 - DNA, 572 bp, Homo sapiens
actagagaccagcaggtttggaagtttcaaattagtcttaaaaatatctttaagtctaactgggaagactagaatgtggctatgatgtatgacttggagaaataaaaacagtataggttagaaaatgactattttatttccttcaaggttcagtagtagttgtctgttacatgtgtggaggttaatgatgaggatctagtagttctcattatctattgctgtttaatgagccttcccaaaagtttgtgcctcaaaacaacataattttattatatcacagcattttgtggctcagggatttgagcagggctcagctgggagattcttctgccccacatggtgttgactggatcactcagcggtgtttagctagcagctagtccgatctggaggatccaagacatcttcatccatatgcctggtgccttgatgcagagggctggaaggtagggctcaggggtcctctccctctgatgtagtttcaggccctttccagatgacctctccagcagggtgtttgtacttcttacacggctgcttagagctccaagtataggtggagccacttacca

SEQ ID NO: 91153 - DNA, 435 bp, Homo sapiens
aatgagaccatgtatctttaaaaaaaatcttctgcagaataaagctcaaagtcttcatttgatctacaatatctttcatgtcgtgctcccagcctgtctctccaagttcaccttatatcccttgcctttaatttcaacaaggccattgctaatcgctgaaattgtttgtattcattctctaaacatacattggttcttattaagtgccaggtttgagctattcactgagatacagagaggaacaagacatagtctctgccctccatgagcagagtctaatagagcaaatgcacacatgcagcccagacctcccttggattatcctgctgtataaaagtgagatgcatttggtgcagattcccattccacatggtattagttttctattgctgcataacaaattgcctctaacttagtggcttacaacatacaatt

SEQ ID NO: 91154 - DNA, 285 bp, Homo sapiens
atagagtgagactctgtctcaagaagaagaaaaagaaaaaaaactcactttaaactctgctagaccattgcccttgtatgtgaaattttatctggatagaagaagatgaggaaaaaaattttcttgtcttttagtggaggagaatgacatgtaaaacaagtattctttaaaaattccaaatatgatatgagaactaccccataaagttgtgaaggtcacattggtgaaaggaaaactaagtgctgtgtaaattacaaagttgtctaagtatccacctggtcctta

SEQ ID NO: 91155 - DNA, 222 bp, Homo sapiens
gggaagctgaggcaggagaatcacttaaggccaagagttcaagaccaatgtgggcaacataataggacccccgtctctacaatacatttttttacaaattagctgggcattgtggcacacatgtagtcctagcaacttgcgaggctgagacaggaggattgcttgagcccaggagttcaagaaccaagtgtataatataatattagtgttaaatggatgact

SEQ ID NO: 91156 - DNA, 303 bp, Homo sapiens
tctgcctgccagccgcgtccgctcttggcgtctgcctccggggggtgctgccttcccatccttatcccctcccttcgtccagagccggctggaaaatgcctcttgcccccttttagaatggagggatcattgtgtgtctccatgggtggagtggctcggtgaggcaatggcagggggctaaatatgggcttgtcttggcgagggcgcctcaccgcagttggagatgggggccccctgcccgcaggccaccccctgctggtcttccccagcctcgtggcccagatagatcaacttcagccctga

SEQ ID NO: 91157 - DNA, 275 bp, Homo sapiens
aatctactgcagtattttctgtcctgtcctatcctactctattctttccaaatactagttgagaccccctgtacagattgcatgactcctccttggattcgtcaacaccacagttaaacgctctgctcatatagccttcacaatggcctgtgaggcacgtcttgttcctggaccactgtggggataaggagtggagtgacttgcctaaagcctcccagctagtacaaggcacagccagccagcctttctacttccatctcaagcaaagtttgatg

SEQ ID NO: 91158 - DNA, 549 bp, Homo sapiens
gttaaagtgattggtgcttccacctttggcagagtaatctggggacgcgatgggtgagatctatctgccagggcaggctgagaactctttttcaggggaaaattgcagttgtgctccctcaccttccctcagccctcctctgttaggtaggaacatactaggttttgtcatttccacaaaagggtgaaaagcctgtaatctgtggtagatagatcttagagcatgcatatccccctcccactttattttcttttactctttttcttttatttatttattttttagagacagggtcttgctctgttggccaggatggagtgcaggggcgcaatcatagctcactacagcctcgaactcctgggcttaaaagatcctcccaccccagcttccccagcagttgggactacagttatgcctggctaattttttttttttttaactttcttttttcccccccgagatggagtcttgctctgtcgcccaggctagagtgccatggcgcgatcttggcttactgcaacctcctcccccttggttcagcgattctcg

SEQ ID NO: 91159 - DNA, 274 bp, Homo sapiens
gtgaagagtagacttagcttggggaaggatgaagcaagaaacttttctgatttcttataagtgtgtttatattcctgtaaaaactatgtacatgtattattttgataaaaaagaaattataaagttaaaatagtataaagataattaagcaaggtcaggcagagtagctttaaagtaaataaattacaaaaataatgctgctacaaatattggaacaactgcttgaaaagtgggtggtgaataaacaaatgctacttttggtggaatgttattt

SEQ ID NO: 91160 - DNA, 510 bp, Homo sapiens
gcaatgacagtagagctatattgaatggatttaggatttccaagtgccaagctgaaaggaaaagctgtccaaatggagggaacagcatttgcaaaggcccagagagatagtgaaacataagtgacattgagcctgattcccctttatcagaaactaaagtttgtgaaacggtgtggggaatgagataggaaaggtaagtggggcaggatcagtggaggacagtgcagttctagtatctagcaaggacgtaaccgtgatggaggcctctgatctcaaccacttgagcaaagtagcagcaatcatgcctttgtactgcagtttcttttaataaaagtaggatgcacttgtagtctggattctcaaggcacataggcctattgacaaaacacaggatccatgaggcctgaatcttgatctaaagtccaccactcagttttggactagtccctgctgcctcccctgccaaagcatttgcaatctaactctctgtagtcacacacactgtgtagt

SEQ ID NO: 91161 - DNA, 617 bp, Homo sapiens
ccagcctgggtaatccttagggcttttctcaggaatgcaagggtgatttgatgttagaaagctattattgtgacttactgtgtaatgctcatctccatagagggagaaaaggcatttgataaaattcattgctttttttaattaagtaaacaccctgtatttatggggtatatgtgatatttggtacgtgcattaaagttcattgctttttctccttgggaggttgaggtgggaggattgcttgagcccaggagtgttgaggttgcagtgagctgtgattgtgccacagctttccagcttaggtgacagagtgagactctgtctcataaaaagaaaagaaaggccgagtgtggcagctcacacctgtcatcccagcactttgggagggtgaggcaggaggattgcttgagcccatgagtttgagaccagcctgggcaacatgaaaccctgtctctaaaaaaaaaaaaattttttttaattagccagatgtgatggcatgtgcctgtagtctcaactactcaggaggttgaggcaagaggattgctcgagtccagaagtttaaggctgtggtgaaccatgatcatgccattgcactctagtctgggccacagagtgag

SEQ ID NO: 91162 - DNA, 352 bp, Homo sapiens
tcccccgactctaaaggtgcttcgtgcttagtgtagaaactgcagaagaggcacaaaagaagcccaattcagtgcagtcgtgggtggcgccatttgcgaatctctagttaggagcgggctctgctggtctccgtcgtatgcacatctgtgtctgtatgagaagcacggctgtgattgttctgtaaatctggcttcttggtctgcattttgcattttttctttttaaggaatgttgtcatgagcgcttccttaggacactatttttaatgtttaacttttcagtagctccaataatatctcatcaaatatttcataactttttaactattcaccctctgtggacatttaagtg

SEQ ID NO: 91163 - DNA, 3871 bp, Homo sapiens
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctga

SEQ ID NO: 91164 - DNA, 4192 bp, Homo sapiens
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctcctggcacctctaaacacacccaaataactcacaagtactgatttaacactctgtattactgaacttctttgaactattttgaactttgaatctcttctctgaataactgccgaaactcaaagataataattagttgatgaaggttatcaattaataaaataacacagaccagtcttaccaaactctaaatacattttaaaaaatag

SEQ ID NO: 91165 - DNA, 3818 bp, Homo sapiens
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctga

SEQ ID NO: 91166 - DNA, 1568 bp, Homo sapiens
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctataaaaatgccttgaataaatgatttcaagtgtc

SEQ ID NO: 91167 - DNA, 3811 bp, Homo sapiens
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctga

SEQ ID NO: 91168 - DNA, 470 bp, Homo sapiens
taatgcttattatgtttttactgttaagatctgtggatttccataggtgttattcattcacttattcaccaaatattcattgagctctgactactccaagacggttctaggagctttggattcagcaatgaacaaaaagaaacaaaatgccttagactcttggaactgatagtctagttgggaaaggaggattgtcactactatataatggatgttttatttgtagttttgtctttagttaatattccatgaatataataatttttcttttttcaaaatcacagtacagcatacagggcagatgtcagagattatgatcacagggtgctgctcagatttccccaaagagtgaaaaaccaagggacatcagatttcttacccagccgaccaagatattcctgggaatggcacagttgtcatcagtaagtaaatgggcctcctgggtacttttgggttgcttttcatttctc

SEQ ID NO: 91169 - DNA, 3715 bp, Homo sapiens
  misc_feature (3636)..(3638): n is a, c, g, or t
  misc_feature (3643)..(3643): n is a, c, g, or t
  misc_feature (3645)..(3645): n is a, c, g, or t
  misc_feature (3650)..(3651): n is a, c, g, or t
  misc_feature (3661)..(3663): n is a, c, g, or t
  misc_feature (3667)..(3667): n is a, c, g, or t
  misc_feature (3670)..(3670): n is a, c, g, or t
  misc_feature (3682)..(3682): n is a, c, g, or t
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactccggtnnnttggntnaaagnngtgttcccannntaanccntttcccaggggntttttggaaaaagtgttaaagcggcgccattaa

SEQ ID NO: 91170 - DNA, 3818 bp, Homo sapiens
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtatgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctga

SEQ ID NO: 91171 - DNA, 2983 bp, Homo sapiens
tccgctccactctgcagtcccggtgggcgaagggtgaggagtaagggacctagaggggtagggagttggagcggggggcgccgggttgtttcactgctgcgcccgtcgcctgctgacgtttaggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctga

SEQ ID NO: 91172 - DNA, 425 bp, Homo sapiens
atatctgcatgatacctgtctcatcatacctttggcgagtctcgtggcttcactaaataccctccaggaagacttggatctaagttcctttgcccagtgaattctttatccctgctcactgcccggcttcttgcagctactgagatttatccacactgctgtccatacaccaggaccccatccctctacctgcaagtctcaaagcaccataacacattgctgttatgtgtaacaaactcttactgaaggttaggggatgatgatgaggggctgcatcaataaataaataaataaataaataaataaaaaagatgggaaacaactaaatcaaataacagaaggcactggccaaaggccctcagctgtctctaccacagtgacggtcttgctggtgacattcccaactttctcacaaagccatcatt

SEQ ID NO: 91173 - DNA, 913 bp, Homo sapiens
agaatggtcaggctctactgaaaatgtgaagatgatcagcaggctgcttcttgtcctttgcgtctactttcaaaactgcccactcagagagaactttcctgtcctgctgacccacaggggtcccagatgttgtccttaccaagccctgttttattttcagctgggctcttaacaccacttaatgcctttttgtgtattgatttgcttagtgtatagcctcattagatcttaagctttttgtgtttgggtttgttttgttttgttttgttttgttttgttttgtttttgagaccctgtctctaaaaaagaaaataaataattaaaaacatatatgataggcgtgagccaccgcgcccggccagtactgctctttacttcattttatagaggaaactggaaacgagaaagttatataacctgcccaaagtcaggcagctagaaaaccacaggcagggtttatacccaaagggtctggcttcagaatccatgctcttaaccaccagctccaccaccctatgtcctttgatgcccagatgtcccagcttttcctcctttgggaaggcttttctgaatacctctccccactgtggtccctccctgactatatacatcctctccatatgtaccatataattttttgattttccactatgtccagctgtaacttcatggaagctgtctggagcttcatgtgagaaggaatggtcacttgcccttggcatgaaaagcccccagcttgccctggtcgctctaatatagctgttgcagagccagagtaaatatctgtggaacaaatcattggaaacagatgacaccaggatttgggggctgttagtcaatggcctgttatcttctttgaaaatagccttgaacaaaaacaattccaactgtaaaatcatcccacttgtctact

SEQ ID NO: 91174 - DNA, 512 bp, Homo sapiens
  misc_feature (39)..(39): n is a, c, g, or t
  misc_feature (506)..(506): n is a, c, g, or t
  misc_feature (509)..(509): n is a, c, g, or t
  misc_feature (511)..(511): n is a, c, g, or t
cacataggaatttggcctcgggcaagattcggcacaggnttttttctggggcaggaagtaagtgcccatcaggacaaaaggccttatctaccactttcttgtcatgctttcttttcaatcttttccttttgatttctttccccctgttctcttttgacactgaacatttttcctttttttattatcatgatccctttatgatatcaaactgaacaagataaatattataatcactaaatctcccatacctaaaaggacatctgatacagatgagggattcttttatcatgtagtgctttgaactatctcaaatataggcacccagaccaaacagaatagaagcccacaacaaaacagaaatgtatgcaaagaagctcacatgtggttgctggaatatttacagcagctaacagattaacctgtcatacagcaacttgacaactccagggttggcaaatgctgatatgcaaatatgctttaaatgtatctacaaattctaaccaaanaanana

SEQ ID NO: 91175 - DNA, 896 bp, Homo sapiens
ggctctcaaagagtggtatacagaatccgatatggtgcttgttaaaatgcaggttcctaggccctgactatagagattatagagaagctgcttcatgagggctgggcacagtaaaatacattttgacaagttccccagttaatcctaatgctgcggtcccagcatctgggcatagggagctcacttagtggcaacagggtggagtggctaaaagccagagttttgaggcatctagccagtttgtaagtatttaatgagtaccatcaatttgccaggtacctggattcaagttctatctgtattattaaataactgtgtaactttgaactagagtgactgaacctctctcagcttcagttatctataaaataaatcagcctaataatagtatcctcctgaaatagacacaaagcattagcatagtacctggcacacagtaagcaccacatacatgttatcgctacccattttaattattattagctgtcacttttgagttctaacacaaaaaataatttgggccaggaaaagaagatctaccaagcctgaggccaacaggaattctcgatcatttaaaaatcttggccaggtgtagtggcttatgcctgtaatcacagcactctggctgaggccagagtatcacttgagcccaagagtttgagaccagactgggcaacatggcgagaccctatctctataaaattttttgttaaattagccaggtgtgctggtacacacctgtagtctcagctactcaggaggctgaggcaggaggatcgcttgagcccaggaggtcgagctgcagtgagctacatttgtaccactgtgctccaacttgggcaacagagcaagatgctatctcagagaggagagtcagagaaagagagacagaaagg

SEQ ID NO: 91176 - DNA, 848 bp, Homo sapiens
gcggccgcctcctcccactctgcgttctcgcgctcactgtgccctgcccgggctcgcaccttgcccgtgcccttcactcgctcttccgcgtgatttccccgccgtctttctctaccaactgggaatgctaaaacgggactgatggacgtgtccgaactctgcatcccggaccccctcggctaccacaaccagctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccacttacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccatgtgagtgtcagggcagtc

SEQ ID NO: 91177 - DNA, 576 bp, Homo sapiens
gcggccgcctcctcccactctgcgttctcgcgctcactgtgccctgcccgggctcgcaccttgcccgtgcccttcactcgctcttccgcgtgatttccccgccgtctttctctaccaactgggaatgctaaaacgggactgatggacgtgtccgaactctgcatcccggaccccctcggctaccacaaccagtaggtgccctgcttctcggtctgtctgtccttctgcccgtctggcagtctctgtcctggggatcgcagttccttttctgcacattcttgtgtaaaagtggaagggacttcgggggggcacttgggggacgaaggaggggaaaagccgcacacttctgggtttctttctagggcataaaccctcctctaactttttcccgcacccccttttacaaatccacactttcaggcaagagtggcgctttctcatgcactttctccctttctctctcctctctgatcttgctccggggtgagaaaatatttgagtttttgtggaatggagcaagaagggaggcagaagcccagaacaggtgcagggatgtggttgcaaggatgtcctgtc

SEQ ID NO: 91178 - DNA, 3033 bp, Homo sapiens
  misc_feature (1090)..(1090): n is a, c, g, or t
gcggccgcctcctcccactctgcgttctcgcgctcactgtgccctgcccgggctcgcaccttgcccgtgcccttcactcgctcttccgcgtgatttccccgccgtctttctctaccaactgggaatgctaaaacgggactgatggacgtgtccgaactctgcatcccggaccccctcggctaccacaaccagctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccacttacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctangacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggcctgggccagggctgactcccttcaggagtggaggccactggagcaagtgccctctcccctccaccgagccaccaagaggcagcatgtgcatttcctaactcccttgccccctcccccatctgtggcctgggtgggcactgctcaggctggataccacctggaggttttccttccgcagagggcaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaagg

SEQ ID NO: 91179 - DNA, 450 bp, Homo sapiens
agaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaaggaactattg

SEQ ID NO: 91180 - DNA, 481 bp, Homo sapiens
gttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccaggtaactttctgcagcttttccatagaagccctggtcccacctccttggctctaccccaggaacctcccggcctgggcttctgggctgggacgtgctgaggtcatcccagacaggagggagggctggctgaaatccacaaactgcagagcagctctctgatggtgtcccacacagaaaatgttaaggatttcaagagccctcccagaccagtgatgtgtccctccggctccccttgcctgtggggaatcgggtctgagtcacttgatgagtaggcact

SEQ ID NO: 91181 - DNA, 3777 bp, Homo sapiens
  misc_feature (1834)..(1834): n is a, c, g, or t
gaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagccgggagcccatggagcactgtcctcagagatgcgcaggttaggctcactgtctaggccaggcccaccttagtcactgtggactggcaatggaagctcttcctggacacacctgccctagccctcaccctggggtggaagagaaatgagcttggcttgcaactcagaccattccacggaggcatcctccccttcctgggctggtgaataaaagtttcctgaggtcaaggacttccttttccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccacttacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctangacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggcctgggccagggctgactcccttcaggagtggaggccactggagcaagtgccctctcccctccaccgagccaccaagaggcagcatgtgcatttcctaactcccttgccccctcccccatctgtggcctgggtgggcactgctcaggctggataccacctggaggttttccttccgcagagggcaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaagg

SEQ ID NO: 91182 - DNA, 939 bp, Homo sapiens
gcggccgcctcctcccactctgcgttctcgcgctcactgtgccctgcccgggctcgcaccttgcccgtgcccttcactcgctcttccgcgtgatttccccgccgtctttctctaccaactgggaatgctaaaacgggactgatggacgtgtccgaactctgcatcccggaccccctcggctaccacaaccagctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccacttacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaagagctgtgctgtctaatatggcaaccaccagccacacgtggctcccgagtgctggtccaaacagaggtgtgctgagtgtacaacacatgcctgctttagaggacttaataggaccataaaaggcagtgtaaagtctggtggtgatccttttaaaaatgtgattgcatgcagaaaggctaatcttctggacatgttaaataaaacatattgtgaaattagca

SEQ ID NO: 91183 - DNA, 360 bp, Homo sapiens
cagacttcatccttctctactttcggggttctggtctgcctccaggctccaggtcctgcttgggcccttgcgtactcacctgtagtctgagaagagacagagtccaaggagcacaagctttggagccaagtagacttggacaagtttcttatcctttcccaacttccattttcttttttgctcataaaatgcaggcagaaacacctggggctatttggggaattaatgtatagaaagtatctaaaacatacaagatgcttatactaattattatgtgcttgctgaaagacatttgccaaaatataactgtttagatcacacttcaattctagtcatccagaattgaatcccaattttggg

SEQ ID NO: 91184 - DNA, 345 bp, Homo sapiens
cagtgaggacgggccagcacatagtaggctccgttctgcgatcctacgtctctagcccacttcacctcctttcatggaagtggggtgggctagagacgtagggatgcagaacggagctggtcaaaagtagatgtttctgccacatctgcaaagtgagcaaaagtagtgagcttcccgtcaaaggaggtatgggagcagaggctgaatttgcacttggtggaggagggttacctctactcataaaactgacaattactgcacacttactaggcacctggctcagggctaagacgcctgcctttattatctggtgcctcagcactgagccattgatggcggtgtcag

SEQ ID NO: 91185 - DNA, 243 bp, Homo sapiens
tgtctggcatccaggggtacacaaagtattgattctagctaaagggacttactaaatactgtttgacaggaggcccacaggtgtctatgtgggctgcagtggaactaagaggtctttttgttcagctgttaaaaaattagtgtttgtagcttcagaggggccccagagaacctttcctgacccatttagaggccatctgtgtggctaggatggctttgctgtcacagaagggacagtccacac

SEQ ID NO: 91186 - DNA, 465 bp, Homo sapiens
attgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcactt

SEQ ID NO: 91187 - DNA, 354 bp, Homo sapiens
tagctcctgtaacattgcatacaaattatttatattaatagttttaggacttgggtgaaattcttgaactatgaataattttaggaacttatttctataaatcatattgcatcaacaaaaatgcttggtatgtagaaggatgttactgaatgagagacaaataattactgaaataaatgttatttctaacaatttctattcaaaatttaagatatttgtattcaagtggtatggctcaggggagatgaaaatgcaaattagtgaaaaatgatctctcatttttgcatgtttacatactcgacttcgcttctttagtcattaccatgaatggaaaattgtggctgatgctgaaga

SEQ ID NO: 91188 - DNA, 1041 bp, Homo sapiens
gctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagagggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgacgcggccg

SEQ ID NO: 91189 - DNA, 994 bp, Homo sapiens
tcatgtgtttgaggtttgaaaatcctttgtcccaagcctttctaaccacagctcagttgctgagcagaagagtaggttaccatcaagtacaaaacatgtagcacggaaacatcactgtggatccagcttttaacttcccagaactctttatcagttgctcccacgttgaaaatttggattgagtggtgctcgtcttccaaaacaaacttgggaaactgagccagagcacgcctctgggagagctcaatgtaggaaaaagggcattgagctttgcagtttgcaaagcttgttccaggaagtgctgagctgcaaagctgtgaagaaatgatacttgaaacagaggatagaaatgtgcctcatttggaataaagcctgtctctaaaactggtattttccttttaaaattgccttgggaaaataggaaattaattttcactttgctccttattttacagactgtagacttttaattctaaagagttgtggagcatgtcttacatttaagggcatgcttaagaccctggcaggggcaagctttcatgactaacttcactgattctttgaagagtagggatgtgttctgatttcagctgtcattagaatggtgaagatgggccagtactttgggaggccaaggtgagtggatcacttgaggacaggagtttgagaacagcctggccaacatggcaaaaccccatctctactaaaaaaacaaaaattagccagattacccataatcccagctactcaggaagttgagttcacttgaactcatgaggcggaggctgcagtgagctgagatcacgccgctgcactccagcctgggcaacaaagcaagactttgcctcaaaaagaagggtgaagatgaagaagggaaatccttggaacatcatctagttgtttcgttgcaggcttttttcctgcagccataggcacgattttttctgttgccaagtatgggagacataggccctgaggatgcccctggacatca

SEQ ID NO: 91190 - DNA, 451 bp, Homo sapiens
gtaaaagagagcacattatcaaaactggctgtacttaacaaataccaacaaaaagtcattacacttctggcaacaaataatgtttgatttaaaaagacaagaatttccccttttgctcttattttttaaatatgctatgtccttaagtgagaaatgcacttcaaaaattttcttattctgaagtctagccagaaagtttgaacttgtgttgcctttggctagactaggtgaaattaaggggcttaagagggcactgttgtgtggccctgtggtagataatagccctccaagcatgaggatgggagatctaccattcaccagtatttccaaagttatattcttaaaaaggctagatttctaatttccgtagaatctaggtatgttcttttcaactcagcatctgataagaaagtttgggcaagtaggtgcgaaaaatttactctagatacca

SEQ ID NO: 91191 - DNA, 389 bp, Homo sapiens
gcaccagcctcagccctgggtatgatctctctgtaataatattgatgacaatgttggtgttagcttccatggctgagcactgagccagcattcattgtctccttactgcaacatgtgggctccatactactagctccctgctactggctccattttaaacatgaagaaatggaggctgagagaggtgaagtgacttgcccaaagtcacatagtcggtaaacggttacaatttaaacccaagtcttttgcccctgtggtctgtgcccataatcagattctgtatacctctgaactcctccaccttccttggggcctggagtcttgggactgacacaggttcaaacctgggttgtttctggtcacatccatccttcagattcctgcagttg

SEQ ID NO: 91192 - DNA, 380 bp, Homo sapiens
gaagattctctgggccagagggaaaggaggatagacagaggaggagaaagagactcaaatgctgagagtgtttctgaccccactctctctagaaccaggcgagggcttgtgcccatgatcttgtgacaacagaacctaagctcttaagtaggctttgagattcaggacaagtgggcttggtgcctcttcctggatgtagcctggggaggtggcaaggcttctggctctcctccactccaggcctgtttggtggcaggaaggcaggaaaggccccagtcctcagattggagaggagattctccgagagattagcatctcctggagaaggatgagcggagacctgggcagtcttggaaaggccttgtggttaaacctggaag

SEQ ID NO: 91193 - DNA, 304 bp, Homo sapiens
taaaattcctcaacaaaacatcaaattttatggtaaataaagcattctttactgcagaagacaatgcagacatcttactgcctgactcatcagtaaatgcgtatcttttatatacatgttgaaacaatagaatttatgtcttagaagacgtctatacagctaaggtatgcaccaaagctaatttgtatgtccatgagttggacaaccaggacaacgggttttaataactacagaaaaagaaagagaagggcaatggtcaccaaaaagcacaatggtgactaatgagttatgactaacagtgttt

SEQ ID NO: 91194 - DNA, 410 bp, Homo sapiens
catcttctctgtcttcactcggtgaggatggactttaggatgcctcacttctcttcctgagattcttgcttccttcttccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccag

SEQ ID NO: 91195 - DNA, 335 bp, Homo sapiens
cctttggccattgattttattaaatgtgctcttcataaactcttggtcagcagatacggtgcagaaactagatttctgaacttagatttatctgagaattctaagtcactttcaatttaagtcaatgtaatcgaatttctgacttcccatttcacaaatgacaatcttatcgtaaataactgtgtacattttatataagaatatatgttatatggttcatataaataaagcatgatctattatatgtcttgttgcacaaatggcatttcaaatcatcaggaaaaatcatatttaaaaaatgctcaaaaactaccaagaaatactgccagaaaatt

SEQ ID NO: 91196 - DNA, 437 bp, Homo sapiens
atgtgtgtataaatgcatagaaaaaaatctggaaagatataaacagatatttatagtggtctagggcaggggatggaattgtagatatttgctttttgttttatgtatatgtttcccataatgaaatgtattgtttatataattaaaaaatatacgaaactttgcttgggggacaacaaagcacctcatttgttaatttgggaaaatcttttattacaatctctgtaaggagttggttgctctctcttctgtactccctgattacataatgctcttctgagcacttttatttaatagcagaatggttgatatcattatttagttaaggtttcctctattatcgaacatctgagttcccagtacactagtctccccttatctgtgggttttgcttccaaggtttcagttatgatcaaccaagatctgaaaatattaaa

SEQ ID NO: 91197 - DNA, 928 bp, Homo sapiens
taaaagataatgcacatcaataccaagcagaatgcttggtacctatttaagtcttaaatattagaagcagatgctagagatgtactgtcatcagatgtctgctcattgactgagtttgagagtgagacactatccgttaggacaagtgtcaggctcctttaagagccatacttaagtggcatttgagatgacaaatgagaggataaaggtgacatcacttttcatcaaatgtttgagccactgtgatatttttattttcttacaggaatttagttgaaaggtctacattttaagtgcaagatctcttactactgagcattttttaagtacacaagtgattcaactaatgggcagatctctcaaggaaattccagatgtctgatatctagagggaatttcagaaagctctctaatcacattcttcttatctaaataaatggaaaacttcatgtagaaagaattgtagtgatgtaacaaccatgtcctctgctgacctttgatgggaaaagatagcaagctcttgcctgagtatcagagtctggctgtttcctcttgaaaaatctcatgttttggagaactgactgggtgacatgtcctttgtcccctgtgctttgtcatgtgattgcaatcctgagcctcacacagacacagaataattatgaaaggggacactgatatgaaaagatgtatagtacagagtcaagccacatagtacgcctctccacagtcagcacaaccaaaagatcagaataagcatgtgctacactgaacataatattattagtatgtgtattattagtgtatggattgctctaagatgctatattgccctgctttagagtgaaaaaaaaaacactcaactattttttcctttgtttatttaaaaataattaccccaaaaacatctggagaaacgtcatcttctcca

SEQ ID NO: 91198 - DNA, 525 bp, Homo sapiens
tggtacatggatatggcaaaaaccaggagagccatatgggaatgattgaagtttgggcagcgctgcaggtatccaagagagagaggtggctcctcaggagaaaactaagacactaaggaaatcaaagcacatctggaggactgtgaaggaagaagagaaagatttgatatcaggttaggtattcacaccagagaaggatagtaactaaaggaaaatctcaccttgaatgtgtgcttgtttgactgtgtgacattgtgaaaagcaacttagcaaaagttctctttgtctttgcaatgatgactggttaaaaagtgaaaatcccagtcaattaactggctattttgtttacataaaggcaactcatcactttttttttttggggtggccttactttaaggcggacctagaagcccggacagggaagtttaacataaagcttggaccttgagaagcagggtggcatctggtcgtgagcaggtccagggcggtgctcaatcctcagccggctgattttggctctctggt

SEQ ID NO: 91199 - DNA, 262 bp, Homo sapiens
caaatatatatttcttcttatatcatagtatcataccccctcttgtaaatttttcattttagttattgaacttttcaattctggaatttctatttggttctttttttataatttctctctcttcattgatattctctatttggtaagatgttggtctcatactctcctttaactctcttgacatgtttcttttagttttttgaaatagctggcttaaaatctttgtccagtaagtccaacaccttggcttcttcatgaacag

SEQ ID NO: 91200 - DNA, 211 bp, Homo sapiens
tgactatacagaagaaaactatcagagttaggttagagagttgggtttggggtcaggttgtagcatgtgttatattatgggttaaattgtgtcctccccaaaattaatatgttgaagtcttaactccctgtacctcagaatgtgacctcatggggaaataaggtcattgcaatataattaggtaaaataaggtcatactagaagagggtag

SEQ ID NO: 91201 - DNA, 292 bp, Homo sapiens
agaatcttcactgtgaatttactgaaatgtccttggtagttttgtgttccccaagaaatggcttttctctctttgcataatttctcaggtccgcatgctccctattcatattttgtgtgggttccacaaagatgaccaaggataggaaaatccagcttcttcttgtaactattagcagtagctacccatttatggagcgcctactatgttctgggtattatgtaagtgctttacatatctttagtccttacaacgaacttgtgagataattctcatcagtcccatattacag

SEQ ID NO: 91202 - DNA, 335 bp, Homo sapiens
tttgcagttaaaggaaactgaggctcagagagaggttagatacagaacaggtcagtggtggagcctggattcgggactgggtctggacagtggagagtttatggtggtccacccccaacggtctggaatgaggggtgcataatcagggctctgctacagtgaggtgcaggcacagtcaaaggcaatgggagaactggaggctgcacctggcctgaggagctgcccagccttagcttagacagtctggagctgctggggactgagagcgatcagggaacctgagggagaggcctgggtgggcaggaggcgaggggcatctctccagcagcctccca

SEQ ID NO: 91203 - DNA, 362 bp, Homo sapiens
gacggttacatggtctacactgaactgtcctgcataagagccatgtgccacatgtggctactgaacccttgcaatgtgaatagttggaattaaggtgtgttgtaaaggaaaaacatgcattggattttgaaggacctgtacaaaaagaaagaatgtaaaatatctcattaatatttttatactgggccaggcacggtggcgcatgcctgtaatctcaacactttgggaggcggaggtgagcaaatggcttgagctcaggcatttgagaccagcctgggtaacatggtgaaatcccatcttaaaataaaaaataataataatgaaaatatgtatatatttttatactgattatgtgttgaaat

SEQ ID NO: 91204 - DNA, 1028 bp, Homo sapiens
gttcttagacctttttgatcctgacttccatttaggatcccctgggtttaacagaaagaatgaagaagaaagagcatttataaaatataatttgcagaaaagcaaaaggaaaacaaaagatatcactagtctttattttttaattgactggttggggtggaaatcagtttgcaagaggttaagcactactaacaacaaaaaaggcaaacatcattgtcatactcatgctaatactagctggtcagttcttttatttttattcatgtttggtggccattttgtggtacccattcctatgggaagattttgcatccctaccttactgaactccagccatattatttgctttgaccaatgaaatgtgagcataagtgatagatgttgcttgagatctttgtgttgtttgttattacgtcataatctaacctatcctgactgataggcagctaacatttattgaatgtttactaggtggtagtctctgtgagcatcactttaaatgaattatctcacttaggcctcccaagagccaagctagtcaataaccaatagtgtgacaagtgtaaaaattttaattaataagcgtaaactatttacttgtgaactttggcaattatagaaaagagtaaaataagaaaccagaagcaaagcagagtcaaaggtttcaaaatctgatctgggtttttacttaatagaaacaatttcaaataatctctggtttttttaagcttatgccattttcttgctgattagtgatcaacagaattttatccttattggtcaccatttcttttcttttatatgtaggaaatgcagttgtgtttaggatatcctaattacacttactttcatttttccaggcttaacataatcctcacttagggaaatgtgacattctcatgttctattatgtgctgatgaaacaggcacctctgcaatatacccatataactaaccctcaacaaagagaataaatgatcatattgggagagtagtctggtgaaaaatatgggcctccttttgataac

SEQ ID NO: 91205 - DNA, 466 bp, Homo sapiens
ctcagctgccctcttctccttgcctggctccatccatttgtctccaagcctatcatcccattgtgcccagattctccccaatcctcacagccctgcacccctgcctcagcttccccttcatttcagcccattccctctgttcattcagcagaagttggctgagtgcccgctctgtgccaggcgcgttctcagtggtgaacgtcactccccacccttgtaggactgagatcccagcagggaaaacagctgcgaagaacaagaggcaggaagtatggacagagcagtgaggtgggtggccagaaaaggctctctaaggaggtgacacctggcagagaactgaatggagtgagggagagcctgtggttatttaggggaggagctttgcaggcacagagaaaatgtccagaagctgtgggaacgagccctggcttgttccagcaacaagaagaaaggcagcgtggccaag

SEQ ID NO: 91206 - DNA, 808 bp, Homo sapiens
gcaatcctgaaccttcttaacctgaactttttcctcctaaagcaatgaccactttaaaacagacagtgttagcttttgattgctattgtaagaaattacaaatttagtggcttaaaataacacaaatttgttctcttaccattctagagatctgaagttggaatggatctcaatgggctaacatcactgtgttgtcagggctgttatttcaggagactctcggggagaacctgtctccttctccccttttccagcttctccaactgcccacatccatggctcagggcccatttccccatcttcaaaggcagttccatcagattaagtcctcactgtgcccctcatctggttctccctcttccgtctgcctcttcctctataaagatcctgtgattacattggaaccccagggaaatccagaaaatcaccccgtttccggggcagatgatgagcaacctcaactccatctgtagccttcactcccttttccatataacccagtggggggttccagggattcacaccggcatcctctgggattggcgggagtgggtgggggtggcaggtgattattctttgcaaaacacatgccatataatttatgtatatatcatttttataccacaaagatgggggaagaagcagagcaatattggagcagagattttgcatcctgttaaaattaagttggttttaatatgatctaggttgtggtaaattaagatattaattggaatcccctgaaatgactaacaaaataacttttttaaataaaaaatgaaaaagagacaataaaggaagtaaaatg

SEQ ID NO: 91207 - DNA, 183 bp, Homo sapiens
gcctcgggcaagagggcgggctgccacccggggtgcagtggcagcgccaaagggtgttaggaaggggtgtgatgtggtaagtttgtatttgtaaaaacctttcttttaaggatctgcggaagaggggctgttttgtgttaagagtaattcagggtagaaccttgaaagggaaaggggagaata

SEQ ID NO: 91208 - DNA, 1377 bp, Homo sapiens
gaagaagtaaccaactctgacacctgactgtaattattccatttcctctcaacatccattattttcaggctctgagactcaagagggatgtgaaatactgggagatacttagaagggagtcaccacactaataaaatagttgttagacttatgagaaaggtgagagaactcaggttggagtagaatgagaattagaacactcttcaggttcctgatggtttttatgtgaaagacagtgagcagctggttattaccactgaggcaataaagagatactgtgggctttagcagaaacaccagtatatatatttagtttttaaaataaggttttaaaaggaatgttttatttaattgcctacacagaatgaataaagtgatatttatagtaggactctgggtttgtttaggagcacatgcttgcacatgtgtggcttaggaaaaaccactgggaccactagtctaaaatattcataagtaaagatgcaaacattctgaataaagtagaaggcagttgcattgatttttttatttgtttatttgtgttttttgttgttgttttgcaaggatgtgttcttggagatttttataatctagaattcacctatttcaagatttctctccagcccccatagtaataaatctgaagtaggagggatgaggtctccaaacacataaatctacagccattttagcttgggggcatgttatagttacaaagatcttatagccatatcaatagaactttttctgctttttttctgttaccctcctttgctcatttgactttttttaaaatttagaaacattcccagtttgctgctgtttttcatttacttggcattgtctctaataaaacctagagtgtactctcttctaaataaagaggtcctacattgtggaggttgttcattcttcttcctagcattttagctcatctaacccaacctattttacagttatgggttaagggtcacctcaaaactaatgtcacacttcatgaagaattggatgacatagaataaaatataaaaaatgtaaacaatgtgagtgtgcttaacaccactgaactgtacacttaaaaatggtgaaagtgatgaatgttgtatgtattttatcataattaaaaataaatttttaaaaagagaaaaaatacttaaataaataaggagtgcgaacataaccatgactagttatcaccatctgatagtgcttcctttgcatgtaaatcatgcttttgttttggggacattcataaagaatagggattaactgaagtggcactgccatgtaacaatagcataattccagtttgttctacttaccaggcttgccctccatgaaaatatacaattgtagataatcttttttaattggaga

SEQ ID NO: 91209 - DNA, 460 bp, Homo sapiens
agcggccgctcgcgatcctaaattttaaaaaaagtcaaatgagcaaaggagggtcacctcaaaactaatgtcacacttcatgaagaattggatgacatagaataaaatataaaaaatgtaaacaatgtgagtgtgcttaacaccactgaactgtacacttaaaaatggtgaaagtgatgaatgttgtatgtattttatcataattaaaaataaatttttaaaaagagaaaaaatacttaaataaataaggagtgcgaacataaccatgactagttatcaccatctgatagtgcttcctttgcatgtaaatcatgcttttgttttggggacattcataaagaatagggattaactgaagtggcactgccatgtaacaatagcataattccagtttgttctacttaccaggcttgccctccatgaaaatatacaattgtagataatcttttttaattggaga

SEQ ID NO: 91210 - DNA, 719 bp, Homo sapiens
gcacaggcccgatgtctacttgctgccaccagcccgggagcagctgaacctgcgggaagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccgagggggaggtgagcgccgacgaggagggctttgagaacctgtgggccaccgcctccaccttcatcgtcctcttcctcctgagcctcttctacagtaccaccgtcaccttgttcaaggtgaaatgatcccaacagaagaacatcggagaccagagagaggaactcaaaggggcgcagcctccgggtctggggtcctggcctgcgtggcctgttggcacgtgtttctcttccccgcccggcctccagttgtgtgctctcacacaggcttccttctcgaccggcaggggctggctggcttgcaggccacgaggtgggctctaccccacactgctttgctgtgtatacgcttgttgccctgaaataaatatgcacattttatccatgaaaaaaaaatct

SEQ ID NO: 91211 - DNA, 494 bp, Homo sapiens
ttcctcctgagcctcttctacagtaccaccgtcaccttgttcaaggtagcacggctgtggcacagggaggagggcgcagggcgaatgtggggcccagggagcagcctgggctggacgtctagcccggaggcccccacaccaccccactgggtcatctctgccccggctcccttcccgaccacagggaaagcatttcacactgtctctgttgcctgtaggtgaaatgatcccaacagaagaacatcggagaccagagagaggaactcaaaggggcgcagcctccgggtctggggtcctggcctgcgtggcctgttggcacgtgtttctcttccccgcccggcctccagttgtgtgctctcacacaggcttccttctcgaccggcaggggctggctggcttgcaggccacgaggtgggctctaccccacactgctttgctgtgtatacgcttgttgccctgaaataaatatgcacattttatccatgaaaaaaaaa

SEQ ID NO: 91212 - DNA, 515 bp, Homo sapiens
gcacaggcccgatgtctacttgctgccaccagcccgggagcagctgaacctgcgggaagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccggtaaacccaccctgtacaacgtgtccctggtcatgtccgacacagctggcacctgctactgaccctgctggcctgcccacaggctcggggcggctggccgctctgtgtgtgcatgcaaactaaccgtgtcaacggggtgagatgttgcatcttataaaattagaaataaaaagatccattcaaaagatact

SEQ ID NO: 91213 - DNA, 203 bp, Homo sapiens
tacttggcattagatctagtattaaccaaactcttcttgaagagtacaggtccttctataagagttattaggaagataatttatttggcacctagataccaggcattaaggtagttcctttaataacatgtcatgtaattaagtctacacagcagccttatagggttgggtactactgttttacagattagcaaagaaggtca

SEQ ID NO: 91214 - DNA, 209 bp, Homo sapiens
tcaaaacctatggaagggagaggaaagaaacaagattgggcagaagaagccaagctgcaatgcaagctgagagacggcctcaaccacagcaagggctattttgaaactaaaattgtccatcagagttgtctcagattaggccataatggctggacctttatacgaccactgcaatcagtcattagatgtgggccatcctgggaggggtg

SEQ ID NO: 91215 - DNA, 360 bp, Homo sapiens
cattgagtgtgcacacttaaaattttactaggttagctgggcatggtagctcgactctagtcccagctactcgggaggatgagacagaaggatctcttgagctcaagagttgaggctgcagtgagctatggttgtgtcactgtactccagcttaggcaatagagcaagacccctatctcttgaaaaaaagcattttacaagggattaccaagttgcattgtttttgaaagctctgcagattctactaaccctgatggtatatgaaattgctcagttcccaacatttttttctgttctggttattatctgtcattaatttttgttaatccagtaagtaaaaataaagtttcattttcaaaa

SEQ ID NO: 91216 - DNA, 307 bp, Homo sapiens
ggcttaggcattttaatttttttaaggttgcctgagtaaatctgaaaataataaattattacagttttgctcaaataaagaacacaaatagaacaaaaaatacataactggctagattacatgaaagcctttttccaaaacagaggtttagaggccagggcaaataggcaggaaaaataaataaagggcatccaaattggaaaagaagaagttaaattagctttcttagcagatgacattatcttacacctagaaaaacctaaagactccctcaaaaaacctgtagaactgataaatgaattcagta

SEQ ID NO: 91217 - DNA, 437 bp, Homo sapiens
ggctggtccccgggtgtggccccacatccatgtcataaatgatgaaacagaaattccatgtcttgcccaaggctgcctggcaacaaacctggggaccaaaacccccaaatgccaaaaccccaggcactgggagccacccaaggctccggacacacctgccaggccacccccaggacagcaggggtgacaggccaagttcccactgccaccgtctggcgtgcgtctcttctgtgctcagcagagaggaaagtggaactgaggctagagagggcgggctggaggagcctggagaggctggctggggagcctggatttccccaccatgctgctccaggactcctgcaaaagcccagccttccctgggatggctttcattcacatgggtgggaggagccgggggagaaatcctgggactcaggggtgcccgggttgccgct

SEQ ID NO: 91218 - DNA, 360 bp, Homo sapiens
aataaataagaatctccaggctgaaatggattcttccccaggatactgaaaactctaccattaatttgaggaaccgcagttgggaaacttcgagaactgataaggtgagagaagctcttacaggggcaaaaagatgataccttttcctcatccaccgcaagggttgtggtcagtactactgttagcaaaagacaggttagcaagaaagaaaatatcacagatttgtttaacaaagttatatatgacgtgggagctttcagaaatgaagactcaaagacccaaggaaaactttctatgcttacatttgatggagaatcatggccatgtagtaatgtgattgcacaaaaagggaatgatcta

SEQ ID NO: 91219 - DNA, 610 bp, Homo sapiens
aaatatgaacatttttgtaaacttcagatgctttcgggcagcgtcctaaactgatgatgacaccttgatacttttaagttgctaaggagtctcaaagattatgaccttgctctgccagctgagagcagtgtggccttaaataatattccttagctgagaaataccactagctctctgcagtacctcaggatggaaggagacaacatgcacaaaagtgcttggtcaactgtcaagcgttacaccaatgaaagatgttcaaatgcacctcaaatttctcaacattttccaaagccaaccaaaacccttagcttctttgtaatagagacgatgaattactaggtaagaaatgagcacccagagatagaagttcaaataatgttttgaagaatgcaaggtcatgccagagaaaacaaactatattcctcaaactaaaatcaatgctacaagatgttgggtcatcactgcttttataagcccattagaaatgtaattagacttgcaaggcactgatactcccctccaaggttgtctaaagaagtaagcaactccagccattagtaagcactattttaaaagtacctgctggtagttgcacagttaccttaaaaaa

SEQ ID NO: 91220 - DNA, 394 bp, Homo sapiens
ccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagtaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattt

SEQ ID NO: 91221 - DNA, 328 bp, Homo sapiens
ccaccccacggagtgaaactcctgggaccagcggaggcgtcaggacccaagtacagagaagggggaattttatgtagtaaatgaggacccaaagcctctcagccgctatagtggtgacgttccccagtgtggggctccctgagatggaagacgcagccacttaacataaccctcccgtcgccaaccctcctggggaatcaggctcaggatccatgggtgtgagagctgccgagatgaggctcagtctgtcacaagcccgcctttgccaagccccaggtcatcacagagccccagcacccactatctccgggggacacctgccctggcc

SEQ ID NO: 91222 - DNA, 491 bp, Homo sapiens
ctgagctaatttttgtatttttagcagagacaaggttttgccatgttggccaggctggtctcgaactcctggcctcacgtgattctcctgcctcaacctcccaagtagctgggaatgtaggtgtgcaccaccacgcccagctaacttttgtatttttaggtgagatggggttttgccacgttggccaggctggtctcgaactcccgacctcaagtgatctgcttgccctgacctctcaaagtgctgggattataggcgtgagccactgcacccagcttgaggttttttttttttctctttgtgcctatttgttactcagttttcctaaaatgagtacatacttcttttataggtaggaaaattaaaaagatccaaaagggaccaggtacagtgtctcacgcgtgtaagtccaacactttgagagggtgagatggggcatctattgagcccagtagtttgagaccagccttggaaacataggaagaccccat

SEQ ID NO: 91223 - DNA, 410 bp, Homo sapiens
tctccagagagtgccaggaaaagtcctgcccagtcaaaagtcttctcttgcagctgggtgttgagggtgattgcccctctctctccttgtaagattatgtttgacagcagtgaaaaccaacagtttaacagcagtaatctcttggcaggacagattgatatgagccttgtcccaaaacaaagtaatcctttcagggaagtgtatttcaagttgagctcacgttcccaagatgctgagattcttatgtagctgacaccggagctgaggctgagccccagccagggatatccaacgattgccagtaacaccacggaactgagtgaagattcaggggctgagtgtgttcctgagtgcttcaaaccgggggacctggaaaccagaggactcctggggaaaggctgtcaactcca

SEQ ID NO: 91224 - DNA, 256 bp, Homo sapiens
gaactgtcaccctctattccatgatgaaatgctctaaatagactgcatccaaaaataacattagtcttttgggtgtcacatcacactaaaaatgtgcagtcttttcctgtttttagtctcatatctccagatgtctccccattatttctgggatatgtcctcatccgttcaaagattgttaagagagtatgatttttcaatgttcctcataagcattactaagttgtcctcttaagttttaattcccctctcctcc

SEQ ID NO: 91225 - DNA, 486 bp, Homo sapiens
tactgttaaggtgctttcatcagagaataagaatagccccaaagccaaatgaaagtgagattccctctgattgttttctggagtctttcttggctagcacccaagcatcccaaatccccgttcagtcctctgcccttttgcattgcgccgtcttcccacttagccctatgtatctccttcatcctgagcgatagtcgtgtctgatgccctttgaagaacaggaaagccgcaagcatttttcgccatggggtctaggaaggaagtaaccacgatcacatttctgtgaagcacttgtccaagttcctagaagctgcatctcctagaagcttcgttgatgacaccacccggttaccctccagctctctaagcatgatgtagggtgtggcgggagagggagagcagggtctgtaattcagaaatgagctccgtccttaagtgaatgaatgcctagatgttctgcgaggacactctgagtatctgagtttg

SEQ ID NO: 91226 - DNA, 352 bp, Homo sapiens
tcgggaggctgaggcaggagaatcactggaacccgggaagaggaggttggagtgagccaagatagtgccactgcactccagcccagtcaacagagccagactccgcctcaaaaataaataaataaataaataaataaataaatgtatgtcctattgggtgaattcactactgtatcttcccgtacacatgaattaagacaaccaggttttgctccactgaattagaataaaaatggtatacaatcataaacattctagttggagaaatgtgctgaatctgaagaaattaagagactctaatttacagcacacatttgaaaagtaacatttattggaatgctgtcaactttca

SEQ ID NO: 91227 - DNA, 1331 bp, Homo sapiens
ccaaagtctgcccagataaaaatctctttatctggattaataagaatgaggcagctgctgttcaccaattttgccaatcaagctgtttggaactagttctgtgtggtgactcatgtgagaagtgaagcagtggtgggctatacagactccagctgctcttgatttggaagcacatgcattttggactgattgaactccagcatacctgcatcattgagggggagacctcaagagggagatagtggacttccttcttaatgctacttgtgggcttttgggtaattggaaagagaggaaactatgtttctgaatgagactgttgaagaggtcataaagattacaagtgatgtgaagagagaaggcacaacaggaggacttgacccagtctagggtcaggaagcctccccatgaaaagtagatttaagccgagatctgaaagataagtagtagttaactaggtaaagggcaggaaaagagacctccaggtagagagtggcacatgagctggccgtgaagtgggaagaatcattgagcatttgaggaaagcgacaatttgcagaaaggcagggtgattctcatgaagctggagccatgttgtaaaggactatcaaggctatgttgatggtgttgaactttaatctcaggattaataatgttaaatagaagcgtggcatgatcaaactaatttgttaagtagactttttgttgatgtataatacatgtagagaaaagagcatacatcaaatgtgcagcttgattttcaccaagtgaacatcccatgtaaccagtacccggatcaagggcggaagccccagagccccagaatgccctcttctagtcattatctctcctcaggatgatcagtatcttgacttccaacatcacaaattgattttgcctaattttgaactttatacatatgaaattattaaagtgtatttctttgtgtttgatttacttcactcaatatgtttgtgagatttgattcagccatgttgctgcacatggttgtacctccttctactttctaccacatagaattctagtgcaccccctctattgttatgggcacttgagtgtaccatttaatgctattaaagtaagggccaggagtggtggctcatggctgggcttggtggctcacgcctgtaatcccagcactttgggaggccaaggcaggtggatcacttaaggtcaggagtttgaggacagcctgaacaacaaacacagtgaaaccctgtctctactaaaaatagaaaaaaatttagctgggtgtgatggtgtgtggtggtagtcctagctactcatgaggctgaggcaggagaatcgct

SEQ ID NO: 91228 - DNA, 494 bp, Homo sapiens
aaaggctaaccaaccctgggtacctgttttacatcattttagattctctcagcttgcctcttatgctagccctgctgcagctaccagttctgtatgagctctgactagcttcaggcaggtacaactcgacagtactgcatctcagccctgtaccacacacctctcatctcccacctggggacttttttgttaatatcaggaaattctttcatcacccaggcacaggaaacctggaaggtcagtagaattaaatccctgactcatgggagccaagaactgatggatagatgttttacctttcctccttcctaaagcaagggtcctgagatgcaagtcatctgaattctcaggtggtctcaggggtttcagcaaccatttgtttctagcagcagcaaactctccctctctccctgcttcacttccccatcctaccttctgctcctgggatcatactccccaacaagaattctcacatgggctctgctttctggaga

SEQ ID NO: 91229 - DNA, 276 bp, Homo sapiens
aaaaaatgaaagtgaagccctttacaaaacaagaattgattttgagcaggatcaatacatgtttgcatataaaaattacaccaactttggaaaagacaatgaaagtgctgaaatctggaaatcactaatggaaaatgaacacttgataataaaaggcacaaaatggaggcttaaataaagtggtgtaaagttgtttctgaaaatattcattatgattcaatgaaactaagagaactggctccaagcatgtatacattctgtttggacctagattgc

SEQ ID NO: 91230 - DNA, 379 bp, Homo sapiens
tgagcaaccgcgcccggcctgcctttttttaaaaaataaaatttgtatttttttggggtactgctccttgtggagcagggctaccttataggcagtgtgtccagagtaggcttgacattgtatttagcaaaaattgactgggttgttttcactttggcatttgacttgactggttctgctgttctggaattattttagtaacattaatgatttcctagcttattttcataatttagaagctagttctttaatatttttgaagtcttggcatccaggaattatgctgaaattgggtatccctgttttataggagagtgttgatttctgaggggtatggttccctttttaagagagaatctcttatatgtgctgatacagg

SEQ ID NO: 91231 - DNA, 212 bp, Homo sapiens
cctggggacaaaatagtcagcaaattctcaaggggagaaaataaagtacttcccttctgttaaaaaaaagtcaagagacaaatctttcctcccccattctcactaatagttattgaaggggaaaaaaaaaccccacaactttttaaactaaagataaaaacaaatgaaaatgaataagatccaaagaatgtcttttgttactctgccttatg

SEQ ID NO: 91232 - DNA, 482 bp, Homo sapiens
agatgatatgctgagagctgggagtacagaatgttgtcccccattccctgctcccgaggaacttagtctgatgggatagacagataagtaaaataataaataataatagcaatgatagcttctgtttattgactacctactatgtttcaatcgcaatataatatctatttctattaattcaactacttcatgaaatgtaagtgttgtccctatttttcaaatgaggaaaccaaggctctaagaagttaagtaatttgtccaagattgcatagctaatagaaaacccaggatttgatccccaatctgcctaacaccaaagtcttccttaacccattcttcagatgattacaaatacagtgtttggcagagggcagtggctcacacctgtaatcccagcactttgggggctgaggcaggagggtcacttgagccgaggagtttaagaccagcctacacaacatagtgagaccttgtctctaccc

SEQ ID NO: 91233 - DNA, 342 bp, Homo sapiens
gcaacctctgcctgctcgggctcaagccatcctctcacctcagcctcctaagtagctgggactacaggcacataacaccacgccctactatttttgtatttttggtagagacagggtttcaccttgtttgcccaggctcacactggttttaaactcagatgaatggggtaggtaagtggcaaaaatggtaacctgcaagctcttcttatacatatgattcctcaatagttgcatttatcttagaaatacttcaataaatcatgatttgagtctttcaccgatacaggtatattctgtatgctgtaaggtaggctaactgctgtaacaaacatttccaaacct

SEQ ID NO: 91234 - DNA, 416 bp, Homo sapiens
tattctgaggttagtgagtaaaccagcctggacagaaggaaagtttcctttaggagattcaagagagaagaggtagctgagtagtaacctgagtaggtggagatcagattatggagtctttagtgttagtatggaaacttaatctttctctaaagttctatctggattctttctacttcctagccattgattaggactcagttcaacagttagctcctccaggaagcaggctttacctaggatagatgttctcttattgtctatattatacatcatttacagattgcctgtaatgtattcccatgtattgccaagctaagcactgtatcttgtccccttgtaaaaaggaagagatgaaatggttattatccccatttcagaaatgaggaaaccttgacttctgcattatacaactc

SEQ ID NO: 91235 - DNA, 980 bp, Homo sapiens
ttgcctttccctctgcagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaa

SEQ ID NO: 91236 - DNA, 1012 bp, Homo sapiens
  misc_feature (936)..(936): n is a, c, g, or t
  misc_feature (946)..(946): n is a, c, g, or t
  misc_feature (951)..(951): n is a, c, g, or t
  misc_feature (954)..(954): n is a, c, g, or t
  misc_feature (956)..(956): n is a, c, g, or t
  misc_feature (958)..(958): n is a, c, g, or t
  misc_feature (966)..(966): n is a, c, g, or t
  misc_feature (968)..(968): n is a, c, g, or t
  misc_feature (971)..(971): n is a, c, g, or t
  misc_feature (975)..(975): n is a, c, g, or t
  misc_feature (979)..(979): n is a, c, g, or t
  misc_feature (985)..(985): n is a, c, g, or t
atcctccccgccccctcggcgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacattttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcaggggcctaaatatgtaaaaatttttatcaaactaccccgatctatggattttgaagaggcagaaagaagtgaaccaactcaaggtctggaactgacagaggatgatattaaagaagatggattgggtcaattcggttatgttaaggtttcagaatggttaccgggtactatatntggtcagccnaacanggngnanaggaaacnanganttcnattnacttanggggctcgccgccgggccacattgatc

SEQ ID NO: 91237 - DNA, 290 bp, Homo sapiens
cgaggttaactgatcatctcattataaactgaaaggacttcaggacggggtagtgtgagactctggctctgcaggaggctgaggccccaggagacatgaagttgatttaggtgcattctgtgtttatatgagagggagtgggctctgcagaggatgggttaagggaactagttgaaggctggggtggccaaagtaagcaactcagatatgtgagggtgtgtggtgcgttcacatctgatttatttacgattgccaaggcacagcagggggcactgctaagagaatttgca

SEQ ID NO: 91238 - DNA, 707 bp, Homo sapiens
gcacctcatccacccgcacagggattactgggctgctgtcctggagggacagacctggaccagctatattgtttcacttattttactggaagccctaaaagttgtatgggagcaagtggggtggggtatggggtgtttatcttgttatttgaaagagccctgtaagattgaacagtctgcactctctgtcctttcctggaagcagagggccccggccaggccccagggactgggcgcttgttttcttagagcacagcgtacttgaggcttggggccaggtggagccgtgctggcctgcagggaggctggccctgctttccctaccaggaaacagagatgacaaggctttgagccctggaattcctccctgcctccgcccttctctcctgctcactgagggcgcgtcctgtgccctgtcatcccaggcccatgtgactccaattggcgtatctgtattccaattccaatgctgaccgtttctccagggctggctgttttccatctgatgggctgggtaattctcaggataccaggtccctgggcagcaagccacgctgttcccatctcccttcccagaaagatgcaaaagtacaaagtcacccactcccccaggcccgggctgctgaccaagtgccagctctcagaacagaattccatgtctcagttcctgttccagctcctcggccgcccctaacacccagcagacg

SEQ ID NO: 91239 - DNA, 831 bp, Homo sapiens
cttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtcacttaatgatagggaaacattctgagaaatgcattgtaaggtgactttattgtgtgaacatcatggagtgcacttatacaaacctagatgggacacctatgacccacccaggccagatggtacagcctgttgctcctgggccacacacctgtacagcatgtgactgcactgaataccgcaggcaattgtaacacagtggtgagtatttgtgtttacaaacataggaaaggtacagtaaaactatggtattacaatgttatgggaccaccgtcatgtaagtggtatgtctttgacagaaacatggttacgtggttcatgactgtatattcactggaagatagtcaagactaaagacacattagagcaaattgacccctttaacatgtgattattgtccaattaaagacagttgatttaagtaaaaa

SEQ ID NO: 91240 - DNA, 194 bp, Homo sapiens
cactgtccgacagtccccagtgagatgaacccggtacctcagttggaaatgcagaaatcatccgtcttctgcgtcgctcatgctgggagctgtggactggagctgttcttattcggccatcttggaaccgcccctacctccagggctattttcatacatcatacacaagtctttacccgtgagtctagactagt

SEQ ID NO: 91241 - DNA, 608 bp, Homo sapiens
gcaccagtcggtgagggaccctgggaccctctggccttttagggttcagctcctttcacattctgtcattctgcttcagaccccacccctgtgcccacaccctgcccttttgtcgctataagctctgcagattctgagacccatccactgaccacagcttccctccttccccttcccttcctgcctccgccaatcctgttcctctgttcttctcctcacagacccccaagccctcaagcccaccctaatctccccactttctcctaggcttcatgtttgttttcctatcccctgcacactcaaaattaggcctaagggcttgatcattggattgaggaggtccagtttttcttttggccacctccctgcatccacctccctgctactcaggatcaatccaatggtctactttctatgcacttaaaattagatctatagttagaagagaagaattcgagtggttctagtataaagaaaagacaaatatttaaggtgatggatattccaagtatactgatttgatctttaccaattatatgaatgtattagattattgcattaccttgaaactgtacatctactatgcatcaataaaaaagaaaggaagg

SEQ ID NO: 91242 - DNA, 319 bp, Homo sapiens
ttttgcggctctctcttctcacgcgatccccccgcggggccgcgctgcctggggctctagctgacctggggctctagctgacctgggtccaagttgggaatcgcaaactctgtggtgcccattagagaatttcacaaactgctgcgaaaccacagtaaagcccccgcgacccaccccgagacgggctttaaaaacactttaaaaatgagaaacgcattacagcttcggctcacaccagactcatttcatgggaaacagtcccgggaagggcgtttggaccccgagtaaaagaagtgggaaaacacacaaaccactcaga

SEQ ID NO: 91243 - DNA, 444 bp, Homo sapiens
tctgctagttactcagtctcttttgaagcctcaataacccatatgtaagattaaggcccttaaaaggtaaaattctacaattctaatcaactatctctttctacaaaacagaagttgtatgtgtctctcatgatttgccaaccactttatctcttgcttttcatagcatcctacccaacagtgtatactccatccacactgaagtacatcgtggctcccagaattcaacacgctctttggcctcaattcctttacacatgctattttctccacctgagcccacctttactcaccactgacatagaggactcaagtcaggtctcctctaatttccccctccctttcctgcaaacactcaagtctgagttaggcactacaaacaacatggctgaaactatagtttttcagggacctatgaggaagaaaaagactggtttcaaaatc

SEQ ID NO: 91244 - DNA, 1082 bp, Homo sapiens
gtaagtttgtaggactggtacctgaaatatactaggcttaccttactgacattttgaaatataagatagctttccaaggcttgcttttgcctcctgattcaggactctaccattggcatcatcaggaagaatttctaatagtattattgatcagagtcttctggaagtttctgcaggttacacatcaacttacttttccctgacaaaataattctgcatctagaaacacaaacaagtagtcaaagaagttatattggaactaagagatgaattaccaaaggaaaactgaaatcaagaaacatttgatgaaattcaggcaatgtcttcaggtgccagaggacacagaaatgtcccgagaaccattcacatgatcttaaagaaacttctgctggttgtcttgtacctttgaagcaggtgtgattgagatggataccttaatttttttaaagtaaaaattgttcattctcttatgtactttagcatactggtattcttatcaaaatatgaaacagcatcaagtttaatattaattataaaacacatggtatatttatatttctgctctttattttctaaagttaactcagttaactctccatataggtatttggacatgggctgtaaccactttttagaacaaatactgtgaagattgttttattacatgacattttatgatgtgagattaacacctttgtattagtaaacatcctagattgttcacttcaatatagatttttaaaatgtatagttatacttgtgcaggatactagaaaatgaaaatgactgttcacacatgctttattattcagtaattttacaagaaaatattactgtttgaaagaaaatcatgcatgcctaaaactgattctgttccagttttataagttagtatactaattttaagacattgtgtatatttccttcacttaatttctattttctactgcatttctaccaatataaaaaacaaagaattcagttggtttctttctagagggaaaatttgttgtgagtatagtactgggcatcacatgctgcttccctttgtggctttgaataaacccttattttcttgtcca

SEQ ID NO: 91245 - DNA, 438 bp, Homo sapiens
gtaatctgaaaagactttagtaaagggtctagttacaaaggtgtgaaaacctcaagtgtaggtacgctacctgtaagctagtgagtggacactgttggcatcccatgccagaagggtggagggaagagatcagcttccaggacccagacacaaagagagctgagtgaagagggctacctgactaggctgtgaccttcagctaacagaacctgaccaagatcactttgcagctacaacactgggggaattcctacttcaaactgaatctcttcactttctctgatactatcctgagactccccattggaaggctcattcacaaagtccatttaggtcagcccccaggggcacagagccagacctacaagagaggagtgtgcaaatcttctcttcccccactggatcgagagagagagagagagagagagagagagagag

SEQ ID NO: 91246 - DNA, 581 bp, Homo sapiens
gagagaatatgaatacaaattggagaagactaaggaatcatgaggctaaatgcaatgtggaatccctgaactgaaaaggaacatgtgacaaaactcatgaaatgttaagtctgtagtttaattaatagtagtgaatcagtgttttgataattgaagcttagttttgataattatactgtaggtatgtaaaatgttaacattagaggaagctgggtgaagggtatggggaattctgaatttactgttgcaactcttctataaatctaaaagtatttcaaaattaaaagtttaaaaaagtcaaaatgaagccacgtggcatggcataaatgttttgtttataatagcaagcagaatgtctgaggaacatagccatagttttaggtattaacctgcatatcacaattagagaagacattaaactagaaagatgtttgctttctagcagggctaggctggatctgagtctggtagagagagagacgaatgcccaagtgattgttttcataatgttttccaaaagtcagatgatgatgtggagtcttattattttgtgttgttgcaagacttctgtgtttgtacag

SEQ ID NO: 91247 - DNA, 352 bp, Homo sapiens
gctcactccattctccacctctcaggctcaagtgaccctcccacctcagcctgccaagtagctaggaccacaggcctgcaccaccacgcccggcaaatttttgtattttttgtagagatgaggtttcactatgttgcccaggttggtctcgaattcctgggcttaagcaatatgcccacctcagcctctcaaagtgctaggattacaggcatgagccaccacactgacttgaaaacattatttttgacagctacatgttattacattgcatagttgtgcaatagtgtaaccatggacctgatattcaccttggtttttaaaataattttaattttattattactactatttt

SEQ ID NO: 91248 - DNA, 353 bp, Homo sapiens
gtaagcctacacactcagtaacccatacagaattaatcctcacatttagatgaagtagcaagagtttaaaattctctactcacagccttgctgttttttttcaatttaacaaagtaagcctactttcgtatcactagaatgtgattacagttaaaaggatccttttaataaaataattaaatttatttgaatctacaatatcagttttttcttgtaattcctttttctttctttctttctttcttattttattgttttcttcgtgtagttttacctcctctaatatatattcttgtgctataagaaaacaaagaagtttgtaaccagtattctaaaattaagtctcaaccaaa

SEQ ID NO: 91249 - DNA, 232 bp, Homo sapiens
ctgggatctgcccgaggcttaaggcatctacccatatgagacaggtttgcactgaagtgcttctgataacacttgaaatgaaccactggtcttcagtccatttgaaccccttggggtatcttcctagatttgctattactttttttaacgagcaaatcctgtaaaattagaagactgtctatacagcaggtggcacttgatagtccatcgagtaccgagtctcgaatccgta

SEQ ID NO: 91250 - DNA, 335 bp, Homo sapiens
ctatctccccaaatctacgtttcaccatttgtactgttatttttttagcccaagccacctttatgtcactcctggaacataataactgctttctcactcatctcctacattttcacctcttataatacagtccaccttgtaccgagcaacaagagttatctttctgaaatgcatattagatcatgtcacatctctacttgaagctctctaaagatttctcactaaaagcgaagtctaaaatttccacccagacctataaggcccttaatgatcttacctctctacctacctctccgatcttacctatcttcaccctcggttctattttctatatc

SEQ ID NO: 91251 - DNA, 542 bp, Homo sapiens
tagtttttagactctctctgagcttcagggtatctgtaaacatttgaagataatttaatgaatgctgtagttaatattttgccatcttcaaaatagcttcattgttatatccaataaatgtttctttaaatttatgttaatgccttttatctttggcatagattggatttttatttaaaactttatttaaagaaagagattctactactatgggaaaaaaatatttacttagaaaaatatagtggtggccagtcctggtggctcacacctataatcccagcactttgggaggccgaggcgggcggatcacttaaggtttgagaccaggttggccaaaatggtgaaaccctgtttctactaaaaatacaaacattagctgggcatggtggtgcacacctgtaatcctagctactcaggaggctgaggcacaagaattgcttgaacctgggaggaggaggttgcaagtgagccaagatcacaccacactgcactccagcctgggtgacagagcaagactctgtctcaaaggaaaaaaaataaag

SEQ ID NO: 91252 - DNA, 264 bp, Homo sapiens
acccccctgcgacagagtgtgctttcaagtgaggtcacaaataatacttttttataagttttggaaaagaatagaatggaagtttaatgataatcaaaatagactgattcatgcattaatttaaaatgtatttctaggctgggcgcaatggctcacacattctgtatcacccagatacagaatggaaaagagtacaaattcatatgtaatcccaaccctttgggaggccaaggcaggtggatcacttgaggtcaggagtttgtg

SEQ ID NO: 91253 - DNA, 1115 bp, Homo sapiens
aaagaaggcagctgggcagctgataggaacaacattcagctccgaggctgaaagggaaacatcagccgcccggggggagttaaaatgagtgacaacactactctgcctgctccagcttcaaaccagggtcctaccaccccacgcaaaggccctcccaagttcaagcagaggcagactcgccaattcaagagtaaacctccaaagaaaggtgtgaaaggatttggagatgacattccaggaatggaggggctaggaacagatatcacagtgatttgtccatgggaggcattcagccacctggaattgcatgagctcgctcagtttgggattatctgaagtgccagaggttctgccactctcaatgacatctgctgtaattttggttgcttttgccctgttgatctgccggagtcttgaaattcagctgattggaagtggtttctttgactttcaaggtcattccctatcagttactactaagagttctcttactgtcagaatctctcttgcagtacagctcaaaatagtggatgcatttcaaacttgaccaccttttcctaccagctagttagaagtcatcaatatttctctacattttgtttatctgtaagtcctttaaatctatttttgctaggcattcattatgattaatagtagacttttaagacaacatttatgtcactccccacctcctcatatttaataaaggagatatttaccttgaatgttggtgaagttgtattaaatgctacgtagaaatatctgatgctgtgttctgagaaccaattaaacaaagaaggcacagtcatacaggaaataagtgcagtgcttacaaaacagcatagcattaagatttgaattctgtaagtttgtaaattgtataatttccgggtctaaatttttttttttttttttttgcgacggagtctcactctgtcgcccaggctggagtgcagtggcacgatctcggctcactgcaagctccgcctcccgggttcatgccattctcctgcctcagcctcccgagtaactgggactacaggcgcctgccaccatgcctggctaattttttgtatatttagtagagatggggtttcaccatgttggccaggatg

SEQ ID NO: 91254 - DNA, 939 bp, Homo sapiens
aaaaaaaaaaaaaaaaaaaaaagacatgagagactattaagaccatactgaacaccagtctactcagaaggatgtaggacagaagtcagagcttgctggcaggacagtggctgggcagtggcagtgggcatccttgcagcagcagtcatcatagccctcagtaagctatcctttcctcaggtaacagctcaggcaccaggagatgagatctgcactggtgagatcagagcttaaagtccccttgccccataggaaccactgtcttttgtagtactctgtatacctacttctatgatccctgcaagggataggtagtgggttgaacagtgccccccaaaaaggtatgtctaaatcctaatcccaggtatccatgaatgtgaccttacttggaaataggatctttgcagatgttaactatggatctcaagatgagatcaccctggatttagactgggctctaaatcctatgattggtgcccttataagagaaaggagaaggagatttgagacaaagacacacagagaagaaggctatgtgaagacaggcagagattggagtgatgtggccacaagccaaggaaaatggagaattgttggctcccctagaggccgaagagggtatggcatggcttctccctcaggaccatcctgctattataacaccttgatttttaatttctggcctccagaactgagagataataaatatgttgttttaagttactagatttctggtaatttgttatggtagctctaggggattaatataggctataacagttatcactgcactctgggaagcacgaagtattggcatcgtcatcaggtatttacagatttttcattgtttctctcagtccagacacagtttaccaattgggtcagtttttattataaccagcgttgcctaataactggtgacaaaccacttatctgttt

SEQ ID NO: 91255 - DNA, 445 bp, Homo sapiens
gatggctgcttctgactcggagacttaaaaaagaaaatgatacagagtttgtaagtttttaactttcagctcaggtcatgacaagatagctacaaaattttaaaaatagcctttttaaaagtttcttacttgtaaccataggtacaactctgccaagaattgggtccaaaatttaattttgcagattgtagaattatggtgaaagttgaataaacatactttctaagtttcctttgttttggaaggagtgaggccctaagatatggaatgaggatacctgggtgaacagctccttctcccatgactgagaaggctagcctccacttctgtgaaagctcttagcttaaactcttaatagtttactattggctaaatgaaaactctcaaaagagtccacatttcatgaggatgagatgcctgaaccttcctagcataatgcagaaga

SEQ ID NO: 91256 - DNA, 245 bp, Homo sapiens
acaagatgagatcatgtggacacaggctcacagtgcctgcacggtgtgagcactcattgatggcttgctttggttcaggaatgcttggcagagctgtgcctccagccccactgctctcctgcctcccaacacccagaggtgttgagggtgaactcctctgcacccaatcctctgtgcatgtgcctgaggaggatggactgtcccctgacaatggatggatgccacctcatggctgatcactgctg

SEQ ID NO: 91257 - DNA, 401 bp, Homo sapiens
tagagacggggtttcaccatgttggccaggctggtctcaaactcctgacctcaggtgatccgcctgcctcagcttcccaaagcattgtcttttattttttatttttattttttcaacatctaagtatttattaaggtgagtttttacaaacaagcatctatcccagtgtgcggggtgaggatgggagaggagagtggggcagcaggaagatgaggattctcatcttttgataataaagctccaggttcatcccattgtggatttcatagtcccccagagacacatggtccttaaaaattgtgtaccacttcttcaggacaatcttgttccaacgggtgccagtttaggctgcaatcagcttcttaaggtccccgatggtatcatccgtgttgcatttaacg

SEQ ID NO: 91258 - DNA, 884 bp, Homo sapiens
aattttggacttgttgctgctgcattcccaaggcccctccaggaggtagaatgatgcagaacacgtgatctggagccaatcagagacccaacatttaacctcccagcccctcagttttcttgccttgaaatggggatcatcatatctaatgggttgttcatgctgacttaatgaaagttgtgattaggtatatgctgcttgttagactcaattgtagggggtagggagtgctgttgactggactcacagcaaagcccttggtggggttaagaagttagtcttgtatgcaggaattctctattcaaagagaatctagaatgacttcccttgggattcttctgccccaaattttcaaatacactctgctaatgaaggaaaaggaataaattttgttactagagtaaacttggtttaggcacaaagagaagaaagaattgacaatttttttgaccttttctatgtgacaaacattttaccgggtgcttttaggtgacatctcattgaatcctcatcatgttatgaagcatataatatgtcttcctaattcataggtcaggaaaccaaggttgacatggccaggaaacttgttcaaagtttcttggtaagtggtagaactggaattggaagccaagttggtctgagttccaaatccaccaccctacaaccatttggttcccattgcaataacctgaaactgatttgccatctttaagaagtgtttctaggtcatagtggatgaggagtgaagaagtcaattcattattcactccttgagtcccactttagactttgcatttccggtaagccttcctactccagtcaggtttatagtcttctccttctggcttgcatagcatactgtagttcctttatcatagttctga

SEQ ID NO: 91259 - DNA, 537 bp, Homo sapiens
gccttaattaaacattttcttccctctgtcctccgtggctccgcctcccagctgcattcatccaccaagtctctatcggtctgtgtcctctcctatccttctggtgagtgctctatagaatgagggaatcagcacttcctgccccccagggagtaccaacacaccacaggtggcaaaatgaaatgtgttttaaagaaggcaacaagagcagaaaaggagctgctaattttgtctggggagatcgagaaaagcctgatggaggagatggcattgggtgagttcagtaagatcagcaagatttgtgaggcagcgaaggtggcatctgacacagagtgaacagcctgtagaaagatgagctgataggccgggcatggtggctcacacctgtaatcccaacatttgggaggcagaggcgggcagatcacctgagctcaggagttcgagaccagcctaatcaacatggtgaaaccctgtctctactcaaaatacaaaaaatgagctgggtgtggcggtgggcacctgtagtcccagctacca

SEQ ID NO: 91260 - DNA, 259 bp, Homo sapiens
ttgtgagtaaggagaaagaaacaaacctatatgtgcctgtgtgagagtgtgtgtgtgtgtgtgtgtgtacgcacaggtacatgcacactctttgcagggtgtactcatttgccaggactgctgtaacaaactcccatacacgaagggctgaaatcaatagaaagaaactgaactctcacatttctgggtttttttgtttgtttgtttgttttgttttgttttgttttgaggcaagctcttgctctgtcactcaggctgg

SEQ ID NO: 91261 - DNA, 591 bp, Homo sapiens
gtcaaaggtgggcagatggaagtagagagaaaccagacatacagtcatttatgtcgagaattacataggttttcagtctgggaaggaaaaggcatcttcgacttttggcatgcaaataccaatggaaagacaacttcccttcataggaggggaaattcaagagggagctgagggaggagaggaggaaactgacctctaccaagcaccactgctgggacccacgctggccctgacattgtcatcatttgtccttgctccaacactgagctctaccataggattaactccacactacagaagaggaatctaactgaggtcgttgatgagtttaagcataactgcttcaagtttagaaaaagcaggttaagagatgcaggaactgtaggacacctgaggggtattctgtaattttcgaggaggtttccttcatgaccctcatcctcttcataagaccacctaccgcccattgctgtcagtccaaagatccagagatcttgctctaagtatgaactcttctcttgcctcccacactagcacctttacgtctactgtctgtcttggagaccccatcaagcttcacctcaaggtact

SEQ ID NO: 91262 - DNA, 2621 bp, Homo sapiens
aacatacattattttttcattttactttgtgctaccacggtttccatttgcttatggctgttggttgtgaggtctagtgctttcttaaaatatactactgctttgcacattgtgggcctgggagctccgggtgccaaataaagattaggactaacacaccttcagtgtttgagtgatgtgggttcccggtgagcacctacatgctgcttacctagtacaggctgtgcagccaagacagccctgtgtggcccagaagaccaaacatttcatgtgaacctttccccttcagggtgataaagatcaggtcgcttgtccccagtccttgttacctccatgttattgattcacttcccagttgccatattcgaggtaagcctccatagctttatctttgctttcatgtcaacaatgcatgtctgcatccttggactggcttcaagggtttctggcaaaaaatttgcagtctgttaatagacttgggcacaaataggacctaaccaagtgtgaagggaataatgaattcagactgaggcatttgggagagactgttggggaagttcatccagtgcagggccttgtcttgttgggtggctcagatatattaatatgacccttatccaaattaacaatgttacgcatttgcccctaaactccaggtgcatcattgagaagggaaggaatttgctttgctttggaggcacattatttcctcagggttctcatttggattgccttggaggttggtgtgatgccacaatgtgcagagaggctgaggacagggagggcaggtgggcttcactttccagccagctctgatttctggggagtggtagtctattcagggggctccgaggccctgtttgggtggattgggaagagtgtgcagttccttagtgatgtctatcataggcacagtggggaactagcaacattcatgctaggtatttgccagccttgacataataaaacagatgtcactgactcctgcctctttgtccagcagtggtcagcactgcttggtcaggctgcagggcatagatgggttgcatcctgagtgagaaaatgcatttccagatatgtttttgtctcttcttgctggcaggactagggttagtgtttatcatttgacttaaactcattcccccaagttcttactctattttcatgtatcggcagttactatttaagttgctgccctcgcagactacagtgagggcaacgagcacagactagagcaaagcttccccacccacagactgattatgcagtgtcactgggagcccctaacactggagacgctgacttaggaagtgtagcgtggggtcaccgggcaggacttttaaaaaatgttcccagatggctctgatcactgtcaggtttgggagctagggatggaaataagtcagtcttatgtatttctcttttttggggctgcagcttttggctgatgcagtttgtatatcagtttctcaaaaatcctcttttatgtgccctgcacagttgtatgtacacaggggagggcctggcagggagccttagctaaatgctgtatgtcatagatcatctggttcttgtggggtgtgtgtgtcagaatcacatgggaaacaccttcagagggtaggggcctgggctcagcgtggggagtctgaggcagcaggtgcagagtgggaggagctgggcactgcacttgtgctttggctgagctcccgctgactctgaggggagcttggtgacattcttcatggtccacaggaccttgctcagaaagaactatgttctcatttaggagagctttgaggcagttgggaagcattgttggtaaggatgttgaggcttgagaatgtaatgcttttttctttactatggcccacactcagcaaataattgcctctgggataaatccccgacccatgcccaccccgatcagggaaacatagtggggagttcagaaacggactcttcagtaggcggtgcctgagtctcctcagatgacctggtgcattgggctaagctgctaaatgcatagcctgaagtggatttgagttggttcctctgcatggtttgaaggctccctcgccacctttcagcacttctgatgagtccctatttttattgtaaaagtatgacaacaatattaagatgaaaaaatgacctcttttatgtttttattttctacatgtcattccagtctttggttctgtgaatacacatctttacatggttataatcacggcccctccagttaattggcttgcccacagttttactgtgaagtagagctgagatttgaagtcggctgggccctctacatacatgtttccttccctttgtgggattgagtagaaggtgcaatatttaggtatgaccacagggtggtgccaaaaatcaacacatagctgcccccacctccattggactgaaaaccaaaccaaaaacctaagcctgtaatctgggaatttggatgaggatatagggagatggctcaggagtctagaagacctggcaagtatggtgtggatggggacagaatttacttcatggtctggtgtaacctgaatctgtagacttgatgcctgttgatataattggtttttaataaatttttgatcctaaaggttttt

SEQ ID NO: 91263 - DNA, 483 bp, Homo sapiens
gagatggggaacctgatcttttaaaagcgggttcccatatgtgaattaatctcaattaaacaaacaaaaaactttgacgttctctcccatgcacttaattaaccgcacataacttagttctgttcctttattttcaaggtaggagaagccaggatggggagatccctaatagatatgactaaatacacttaataaggaactttgtaatcaagtcatgagaaaatgggcctttttgacataagagtggacaagcatcgtgagtggcgtgggggggcttgagcggctcctccctctctcctctgggggtgcccaccggggcccaaagcttctgggaacccggcggagagctctgctcctgagccaggaattgccaggcaccacacaactgctatccgcggggcctgtccggtttccccaagtgcttctgcttcattcgctaatccatacagcgtagctcagaatgatcgcttgccttgggtcccg

SEQ ID NO: 91264 - DNA, 351 bp, Homo sapiens
gagatggggaacctgatcttttaaaagcgggttcccatatgtgaattaatctcaattaaacaaacaaaaaactttgacgttctcataattagtgtgaagctaagactgtaattccaatcttttgatttctccaaataatttctaataaacataatattacttgattcttaagggaagagtaagtaggttttcaggagtatgccaactttttaatggaattatgttataacatgtaaattctaccaatgtatctgttttctgtaactgaactaatttctgtctcctcctctactgtatggtgagagcttgctcgccataactaggtcgctgtggtgcctcccccccatcttc

SEQ ID NO: 91265 - DNA, 300 bp, Homo sapiens
catattcggaaatatggattgataaatggatattttgactgagctgcagtatagcttctcctgtagcctcttgttaaaaacagccccgggtgttggggacagcagtagctggaagcagcaaagtgacacttaagtgccaaggcagatcagcagtttctgacagtgagagttcaaggccatgtggtggggaaggaggagtatatgtggcagagtccacataagtggtataggccttggagtcagggcctgaattctaagctcaactctccgtcaagttgccgtatgaatgtgggtaactcc

SEQ ID NO: 91266 - DNA, 146 bp, Homo sapiens
aggtgaatttggattgttagagaaaagtttcacaaatttcattcctggaacaccaagctcataagacattcattgaaaaaaagtgggccaggcgcggtggctcacgcctgtaatcccagcacatgaggccaaagcgggcagatcac

SEQ ID NO: 91267 - DNA, 4118 bp, Homo sapiens
accggatgtgttttcttccaggctaagtccatcttccggcttgggcagacgctgccgtggaatccttgactctagttttctgagtcgattgtgatcatggctgctgagtctgatgttctgcatttccagtttgaacagcaaggagatgtggtcttgcagaaaatgaatcttttgagacagcagaatttattttgtgatgtatcaatttacattaatgacactgagttccaggggcacaaggtgattttggctgcttgctccacttttatgagagatcagtttttactcacacagtcaaaacatgtcagaatcaccatcttacagagtgcagaagttggcagaaaattgttactgtcttgctatactggagcacttgaagttaaaaggaaagagcttttgaaatacttgactgctgccagttaccttcagatggttcacattgtggaaaagtgcacagaagctttgtcaaagtatctggaaattgatctttctatgaaaaacaacaaccaacacactgacctgtgtcagtcttctgatcctgatgttaagaatgaagatgaaaattctgataaagactgtgagataattgaaatttcagaagatagtcctgtaaacatagatttccatgttaaagaagaggaaagcaatgctttgcagtctacagtagagagtctgacatcagagagaaaggaaatgaagtcaccagagctgtctacagtagacataggttttaaagacaatgaaatttgtatccttcatgtagaatccatcagtacagctggtgtcgaaaatgggcagttttcacagccttgtacctcttcaaaagcaagcatgtatttctctgaaacacagcattcattgatcaattctacagttgagagcagagtggctgaagttcctgggaatcaagatcagggcttattttgtgagaatactgaaggaagttatggtacagtgagtgagattcagaatctggaggaaggttattcactgaggcaccagtgccccaggtgtcctcgaggctttcttcatgttgaaaactatctgcgccaccttaaaatgcataaactattcttatgcttacagtgcggaaaaacatttacacagaagaaaaatctcaaccgacacatccgaggacacatgggcatacggccctttcagtgtactgtgtgcttgaagacatttactgccaaaagcacacttcaggaccacttgaacatacacagtggggatcggccatacaaatgccactgttgtgatatggatttcaagcacaagtctgctctcaaaaagcacttaacctctgtccatggcagaagcagtggtgaaaaactatctaggcctgatctcaaaaggcaaagtctactataattataatcacagacttgttatataaagtttgtattattctattacgcaagtctttctgtagagatgcagcatttgtaatatttcatccccccaatctttgtttcttatattttgtcggcttacacataatcattctttctgaacttctaacagttccaaagttatgggaggcacagtaaagctgatgggattctgtctcatctcataccttacatataagtctcagtagtatccctagagaaatagtgttcctctcttatatattcttgattctagtgacaaaggatccagcagtatttgcagattccgatttggagtctctaggtaattgatttaagtataaaatccaatcatataaaaactttaatgaattaggataacaagaagagaaaataaaggtaaaaacactattacctgtttctagtcactttagaacagatggcactaaaaaaatttttttttaactttttaccagctgttcttggattccaaactaaacaccaagatacttttcattttaaaatgtataaagtaacaattcagattcacttgggaatagcagaatttttttatacagggttaataatccttaaaatacttttatttccatgccttattagtatacatacttaagaaatggttcattgggcccgagtttcttgattttatttaatacaatcggatttaataattttgtggccagtaaaattataccattggcatgaagctgtgaaaaatgagaaattctacctttaccagggatatctgttctactgttttaaaagttcctctctattttattttttatttaacatgaagtaaaattgaaatttcttcttggtgtatagttctgtgaattttaacagaaagatttgtgcaccactactgcagtcggtacagaacagttccttcactcccaatagctctcttatgctgtccctttgtagtcagctccttctagctctaatcctggcaacagttctccgtcactattattttgccttttctggactgtcatataaacagaatcttatagtacgttccctcttgaaatgctttttcacccagcataatgactttgaggttcatccatgtcattttaaattttgaattggcaatatatattctagctgttactagatgagcaatttaaaaaggtgtagctattagtgttgtattttttcatttacattaatgtaatttccattcactatgtgttgataaaaatcttaaccatccctagagttttatatttccaaaaatatgccaaaaggaaaactatgactgtatgattattttagcgagagtcatatttgagatggtgttctgagccatagttctctaacatctccgtctacatataacacaaaacttttataaattattttaacaaagattaaaatatactgcagggcaaataatattctctaaaacacaggaactgcttttcgtaaagaagactgactagatgcatctttctttgaagctgttctagtcctcctctagttaacttagctttatgtagaatttctactgtatttaatttctattgaagcccttctgtattttaaaatgtaatatactttgtaccatttataaaaattgtgtgatgaatgaatcacatgttcgttgttataagtgttaacctttttttgacaattttgtgggaaagacattctccactgaattttaactttccttgagactttcaagaatgcaggtctcgtttgatgaaaaaaccgacttcataacccaatgttactagttagcgacattgtgctgaatttctccttgaactttttaactttatatgtaaaataactttgatcttggtcatttgaaagatcatttccaggtctaaaattccatgattttgtatttaattcttcctgagaacagaagaggggaaagcaagagaggacggttttgtgtctttatgaactttgttacttaagtactccattggagacataatttttctaattagtggatctttttccactggaaagtgtgatagctcattgctaatttttcattcatagttcattgcttccatttgacctaagattggccatttgttggtgtgaaaatattttcttttcagaaatagtttactagtgattgaagtacttttcttatttttgcttcctattataaaatggcgtggggggaagggggaaggatggagatgggaggagagggtaaaagaatagtactctgattttttaagaattagtatctactatcttggatatttgaaaaaaaattggttgaaactatgtttaagttttatgtgtgccttgtaagattgttgtaaaattttttgtgagcactttgagatttttgctgggggaggggtgttttgtgaaagtgatggttattatttatattatttattcctgttcagtagcacggaatgatctccaaacattcctaggagagtgtctgtttgcatgatatgtctaaaaattttcaggaaaatggaatctttttttaaagttcaggtatgacaaagtatagaatttattcatttaacatattcacatttagtttatgtttctgatatgacagaaaaatgaaaagtgtttgagttcagcctcttcatttactccatttacatataaaagatcttgaaaaggtagttgttacttcgttgtcagagaaaaacacttgccctttttcctgggatgtaactatcttacatgtttacataagaaataataaactggaggtgggaatggagaaaa

SEQ ID NO: 91268 - DNA, 2573 bp, Homo sapiens
  misc_feature (2560)..(2560): n is a, c, g, or t
accggatgtgttttcttccaggctaagtccatcttccggcttgggcagacgctgccgtggaatccttgactctagttttctgagtcgattgtgatcatggctgctgagtctgatgttctgcatttccagtttgaacagcaaggagatgtggtcttgcagaaaatgaatcttttgagacagcagaatttattttgtgatgtatcaatttacattaatgacactgagttccaggggcacaaggtgattttggctgcttgctccacttttatgagagatcagtttttactcacacagtcaaaacatgtcagaatcaccatcttacagagtgcagaagttggcagaaaattgttactgtcttgctatactggagcacttgaagttaaaaggaaagagcttttgaaatacttgactgctgccagttaccttcagatggttcacattgtggaaaagtgcacagaagctttgtcaaagtatctggaaattgatctttctatgaaaaacaacaaccaacacactgacctgtgtcagtcttctgatcctgatgttaagaatgaagatgaaaattctgataaagactgtgagataattgaaatttcagaagatagtcctgtaaacatagatttccatgttaaagaagaggaaagcaatgctttgcagtctacagtagagagtctgacatcagagagaaaggaaatgaagtcaccagagctgtctacagtagacataggttttaaagacaatgaaatttgtatccttcatgtagaatccatcagtacagctggtgtcgaaaatgggcagttttcacagccttgtacctcttcaaaagcaagcatgtatttctctgaaacacagcattcattgatcaattctacagttgagagcagagtggctgaagttcctgggaatcaagatcagggcttattttgtgagaatactgaaggaagttatggtacagtgagtgagattcagaatctggaggaaggttattcactgaggcaccagtgccccaggtgtcctcgaggctttcttcatgttgaaaactatctgcgccaccttaaaatgcataaactattcttatgcttacagtgcggaaaaacatttacacagaagaaaaatctcaaccgacacatccgaggacacatgggcatacggccctttcagtgtactgtgtgcttgaagacatttactgccaaaagcacacttcaggaccacttgaacatacacagtggggatcggccatacaaatgccactgttgtgatatggatttcaagcacaagtctgctctcaaaaagcacttaacctctgtccatggcagaagcagtggtgaaaaactatctaggcctgatctcaaaaggcaaagtctactataattataatcacagacttgttatataaagtttgtattattctattacgcaagtctttctgtagagatgcagcatttgtaatatttcatccccccaatctttgtttcttatattttgtcggcttacacataatcattctttctgaacttctaacagttccaaagttatgggaggcacagtaaagctgatgggattctgtctcatctcataccttacatataagtctcagtagtatccctagagaaatagtgttcctctcttatatattcttgattctagtgacaaaggatccagcagtatttgcagattccgatttggagtctctaggtaattgatttaagtataaaatccaatcatataaaaactttaatgaattaggataacaagaagagaaaataaaggtaaaaacactattacctgtttctagtcactttagaacagatggcactaaaaaaatttttttttaactttttaccagctgttcttggattccaaactaaacaccaagatacttttcattttaaaatgtataaagtaacaattcagattcacttgggaatagcagaatttttttatacagggttaataatccttaaaatacttttatttccatgccttattagtatacatacttaagaaatggttcattgggcccgagtttcttgattttatttaatacaatcggatttaataattttgtggccagtaaaattataccattggcatgaagctgtgaaaaatgagaaattctacctttaccagggatatctgttctactgttttaaaagttcctctctattttattttttatttaacatgaagtaaaattgaaatttcttcttggtgtatagttctgtgaattttaacagaaagatttgtgcaccactactgcagtcggtacagaacagttccttcactcccaatagctctcttatgctgtccctttgtagtcagctccttctagctctaatcctggcaacagttctccgtcactattattttgccttttctggactgtcatataaacagaatcttatagtacgttccctcttgaaatgctttttcacccagcataatgactttgaggttcatccatgtcattttaaattttgaattggcaatatatattctagctgttactagatgagcaatttaaaaaggtgtagctattagtgttgtatttttcagagcngaactgggggccg

SEQ ID NO: 91269 - DNA, 272 bp, Homo sapiens
gtgtgagctgccctctcagcctgtaacattccttctacctccctatcttccatccacttttcgggaccaatggcctctggtctcttttttcttccaaaggtttagcagagttttgtctcccaaatgctgcaggcctagaaaggaagctgtgaatgaattttatcaccatctgtgacaagtgatcagagcacatggactatggtcattttagtggcactttgctaaagtaacatgcttccaatgaggagcagcattctacttttgggtgcagg

SEQ ID NO: 91270 - DNA, 242 bp, Homo sapiens
gcctcgtccccctgaactccatcacctgctttttcctccaactcccaccttggcctgcatcaacactcctcaagtgctaaagtcaatttcatcacttctccaagctccagttccagatgccaccacctcagccctggcccaatcactcaccctgggtttcattccccattaggactctaactccatgcctaggagaaacccccttccctggaaagttccaagagatcttctgccccaggtca

SEQ ID NO: 91271 - DNA, 312 bp, Homo sapiens
actgttgctcactgtctctcttactggactgcctccccctggactatgagctacactccaagcctctgtaccaccatgcccctgcacctggaatgcggctggctcacaggagccatgaattaaacacctgctgagagagcaaatgaatatttgtacctagaggaaatcctcctaaggcatgctgccatcctgcttcagacctgcactgaaccccagtgctggcccagctggacatgagcaggaacgtcaggcctgttatatcccatgtgacattaagtcactaaacctgagcctgcttcttcaccagtgatg

SEQ ID NO: 91272 - DNA, 373 bp, Homo sapiens
gattctaaaaagattcttttgggagccttcctactcaatccccaccatctccaggcaaccactgatctgcttcccaccattagagattagactagttttagataatagattaggtcattacacttttgaggagaaattctttttttgctgctgaccagcattcactacatcaataaaaataaatgctaagctttgggtttgtttttatataagaaatgacaaaaatgcccatttgtaagaattgtttcttccacttcccaccttaaagtaatgcaacgtttcagggcaaaattgccttcttcatgagtgggtttgcagtactgattgtatctttcacaatatctgttgaaaataaattcctccttttaaaatt

SEQ ID NO: 91273 - DNA, 337 bp, Homo sapiens
ggaaaaaatataattcaagtccaacgtattactagctgtcaccttccccaacaatcaaataagcattgttattgtcaaacacatttacttgtatagttcagtgttatatgtaatggacttaggtataattcctgtgctattcccttttgatgccaaacacccttttgtaagctgttttgtttgaaatccaaatttatatgtcttaaagtaaatggcagcattgggctttcttaatgtaatgactcttctgccatcctatttctagagttaggcagaaaattctgtaaatctatcttatttccagtctgtttgtgactatggtgggcaataaatctga

SEQ ID NO: 91274 - DNA, 285 bp, Homo sapiens
tggacatctcaccaggtccttcatgtgcaggacagtcttatgaccatgcactcctgtcccgtaggtaccctagttgggatcacagatgctccagggactgtccctgctgcccactcttcacctatttctgtgaagggttaccctcaagaaccactaagtttcttgttagtggtggattggacaaagctttttaaaaaacattttgaaaaacctgtggttttattacttattactctggaaatttggtcaatgcaacacgcttacacttgaaaatatatacatgcc

SEQ ID NO: 91275 - DNA, 220 bp, Homo sapiens
gtttagttcacagttgattgtgatgggcacaaggttggatgcaagcaggaaggtaaatgggtgtaaaagctgcctccttggcccctcaccactaccgggggaagctgcactgcctgagccactcagccccatgcccttctctttgctggaagtgcccataggaaatagagagagggtctttggctgcacctctatgtcaggattaccaggtcagtcttgg

SEQ ID NO: 91276 - DNA, 238 bp, Homo sapiens
aactcctgacctcaggtgatccacccacctcctcctcccaaactgctgggattacaggcatgagcccctgcgcccttgccaatcttctttatttaaaacatcttttttgtatatgttgcatatagaagtgtttttgtgtatgttgtatatattttgtatatagaagcattttttgtatctagaaggcttttcttttcctttttttttttttgtgaaatagaggatcttactctcttac

SEQ ID NO: 91277 - DNA, 191 bp, Homo sapiens
cactgacagcacaactctcagtctgtgacccagggtgtgaagaaagatccaactctccagggaggcagctggcaacagccagacaggattccccaagcaagtcagttcgggtaaagcacagccctagtggggaagcatggcgtgaagcaggtaaatcaagacaaaaatccattcgaatgacttgcactaac

SEQ ID NO: 91278 - DNA, 309 bp, Homo sapiens
tatcgcgccactgcactcctgcctgggcaacacagcgagactctatcttaaaaaaaaaagaatatatcaacgtaatgttattttgtccttgcttaagtttgatgctatgataataattttcctagtcctacatattctttaaataattttgttttctttataaaagttatttgtgggcttcagatgggagacgaatctctatctaataatccataaatataacaggacctaattcaatccatgtaggattcaacgtgtaattggcatagtgcctggctctggtgttgcagctcccaaactgtgcagaga

SEQ ID NO: 91279 - DNA, 484 bp, Homo sapiens
tccactgtcctcttcagatctactgtgaaatttaaattcatgaaagctgggttctgagcctaaaagcaaacaccagggccctcttagaagttcctccatccagcttggccgaagtctggagctgccagccgctgcttccttcttcagagggcaaaataaagcattttttccttaggacactaccagtctcctctgtttccatcactgactccagcaaaagagaggtttagctagggattataaactcaaattcccataggggccaagaagctgaccaggtataagacatatgagcatggtggatactgtggctaacagagaacactctctaaaatcatttttaaaaattttctaaaccaatgtgccagataagcaaatgtctccacagacctgattcagtctgagggccatcagctacacccctcagcttaaaaattcgctactgaccctgaaaacagggggattcagggtccccagcgtgacc

SEQ ID NO: 91280 - DNA, 560 bp, Homo sapiens
tggtgcagtatgaaggaccaattggagacgccagagaatataagtaggtaaacctgttcaggagctgaaatcaaagactcttgaataatttaatgtaatctggaggtgatgaggaactaatgaagtggagaagtgagaatggaaagacaagagctgcccaagatatggtcaaagtttctaggccaggtaaatggggacatggttctagggaacacgttacaaatatcatatttgggggaaaagctgtatcttatcttcttgagtgtttgaggtattgtgggaaatccagaagcaggtgtccagcaggcagccaaaaactccgatcttatgagagaggctggtgagaagctatcagaaagctatactaagttagcatgtctctttgaaaggacaactcatagtaagcttagtcagatgcttgatttgtgtctgcaatgtatattaatatttcacagataggttgtggatgactgagagagagcatgcatcttgcccatgctgttggatacaaggacaaattctcatgtggttgggatacctggtctagatgtcttgccata

SEQ ID NO: 91281 - DNA, 419 bp, Homo sapiens
ctgtaagagctgggcaagtaggcacacacactggtaggtgggtacatgctgggcatatgaggtggagaaactctccgtgattgctgacggacaccactagcccattctacacccttttgagatagaaagaggccaccccctcctccagacagacacagccttcatacagcttggccaggaagccacagtctagatttcactgcctcactggggcaattttgtatagagtacaacgtacccatcatccagagaagccctgatcactggactaactttgtgcacagaaaacaggcttgattcccatctactgtggtagatcttccgcttctaactcgggtcaaatttggttcaattcacccctaagatagggacggcacacaagtttcatccccaacatcattttggattacttggaagag

SEQ ID NO: 91282 - DNA, 496 bp, Homo sapiens
tcgacggtaccaacaggaaaatgctgaaaggaaccaaattggatgaactcataagcttcagaatatctaagcaaaagtagaattcctgcctttagggaagagtaactttcttttggaaaagcatcagaaatggcaaaagtcacacattatccgaaatatgaacctcacttacaaaatcctcgcaggcattctgaatgtcagctattgcaaaatggcaaagcaaactggtctttgaatgtgttggaaaacaagtttctctggttctgaagtcactagagctttaaccaagacaatcagccggtgactaagacaacaatctacagtctgctggatagatctgctgtcaccttctaagaaggacattatagaattctgaggggtcccaagtactaccaatctaatctaattttataggcttagcaagatagtactgggccagtggctcacatctgtaatcccagcactttgggaggctgagacgagcaaattgcttgag

SEQ ID NO: 91283 - DNA, 297 bp, Homo sapiens
aaaatatcacaaggcaaatggaggcagggcgagatcataggaccacaggactggggcaaaattaaaattgctaatgaagttttgggcacgcattgtcattgataacatcttatcaggagacagggtttgagagcagacaaccagtctgaccaaaatttattaggcgggaatttcttcgtcctaataagcctgggagcgctacaggagaccggggcttatttcgttccttacacaactgtaaaagacagccgttcctaaagtggccattttagagacctccccttgggaacgcattct

SEQ ID NO: 91284 - DNA, 442 bp, Homo sapiens
ttattggcaattatgtgttaaaccctgtgccagctatgttaagaaaaacatagaatgatgggttaccacaccccaatttttattaaaagtttacatctatacatttaaaaattcacgtacatgcttagtagtaatagtatgcatgagaaaaattcatattgttattaacatttgagatatttccaagaatttgtttaattttttttctttttgtttgtattatgaaatcacacagcctcctttgagctccttgaagggatttttgtcctctgggatgccctttaccagtggatcctcgccagatcgttcttcaacgtaatctcttacttcttcacaacatttggaaaccttaaggggaaggaaaaagggatgactcatttggtttaaaacagaatactccagatgccaggaatttatttattacaataaattttcaggttgt

SEQ ID NO: 91285 - DNA, 244 bp, Homo sapiens
atttcttcataatttttaaatccctttcatacaaattacaatcccatgaggctaatagggaaaacattattgtttccgttttacagataagaaaagggagcccaactgtagtttagagcagcgagtcagaacaagagctcaggtcttacttgagattcagggctgccttcaaagtttattcccaaatggtctatgctattgagggtcctgggtttttggggttttgtcactctagggactacca

SEQ ID NO: 91286 - DNA, 158 bp, Homo sapiens
gtgattctcccacctcagtctccccagttgctaggactacagaattgtcccactatggctaattttattttttggcggggggtgggggcggtagacaagctcctgctatgttgttgtgggctgatcttgaactcctggtttcaagcaatcctcctgcc

SEQ ID NO: 91287 - DNA, 486 bp, Homo sapiens
gcactttggaggcatctactagaaacaaagtaccctgtgacatgctggaagggatctccggacagtaaaacatacaaggaacagacccagggcaaactgtacttattcatgatgggccctgaagtgtgaaggggtttattcaaaagaagtaggtaggtggcattccaggtaaaggggacattgtgggcaaagacatggggatgaaacgtgtgctgtgtcaactcagggttaaatggattaagggcagtgcaagatgtgctttgttaaacagatgcttgaaggcagcatgctccttaagagtcatcaccactccctaatctcaagtacccagggacacaaacactgccgaaggccacagggacctctgcctaggaaaacagagacctttgttcacgtgtttatctgctgaccttctctccactattatcctgtgaccctgccacatccccctctctgagaaacacccaagaatgatcaataaatact

SEQ ID NO: 91288 - DNA, 252 bp, Homo sapiens
gtgtgtacaacatgaaatttattgtctcacattaactggaagttcaaaggtagagacatgtgacttagcagctgagtgacatcatcaggtacatgttgccctgtctgtactgtgctgtcctctttgtcacctttattccaaggctggctcccctaactgtcgtcatgatttactgtagagtctgaacttagaattggtaactaatccaaggaagcttcctttcttgttccttaactgtagcccagggagatc

SEQ ID NO: 91289 - DNA, 1585 bp, Homo sapiens
  misc_feature (880)..(880): n is a, c, g, or t
gttttttttttaaacgtttccaaggagtgggaaggttttaatgagcatcccagaggaccaggggatacaaactccaaatccagcctttatatcatcattatttcaagcaacaggaggaggctcagccttgcttagctcattcccagatgaagaggcagctggagggaagtccctgaaatccctctctacccagcagaggggctaagggaaagtggagacggtctctctgctgctgctgctgctgctgctgctgctgctgctgctaccactgccaccaagagcagggagacttcaagcgccaagctgacctttggaggtcaggacggacccagaatcaggcaggaatttggcaggcccgcggcggcgtaggacggaggcgtcgctagggtcttgttctcttggccaggctggagtgctgtgggaaaatctgggctcactgcagcctcaacctccgggactcaagtgatcatcctgcctcagccacccagagtagctgagaatacaggcgtgcgccaccaggctcgggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggngtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctac

SEQ ID NO: 91290 - DNA, 411 bp, Homo sapiens
gaccagcagcatcagtggcatctgggagccgtgaggagcacactctgtcagaccccaccccagacctgctgaaatagaaactctcgggatggggctagcaacctgtgtttgatcagtcactcctccaggtgattctgacgaactcaaaagtatgagaattggccggacactcatgcctgtaatcccagcactttgggaggcagaggcaggtggaccatctgaggtcaggaattcgagaccagcctggccaacatggacaaaccccatctctactaaaaatacaaaaattggctgggcctggtggtacacgcctgtaatcccagctactcgggaagctgaggcaggagaatcgcttgaacccaggaggcaggggttgcagtgagttcagattgcaccactgcactccagcct

SEQ ID NO: 91291 - DNA, 1820 bp, Homo sapiens
ctgtgctagtatctcatgctaaaatggtgaaattattttttctcatattcttatgtgaaccaaattaagggttactcgtgtctattttttctcaaaatggaaatgttttttattataaaatccatgctctttgaaaaattcagcctgtattgaagtacataaaatacaaaaatgaaagtcattttgactcccactccccagagataatcaccatgtacagttaattccttgtttaaaacgagagaaggcaacatttgatcacagctgtgtgtgcctcactctgcctggggatggcctgtggtgattcatggactcatgttctctgttcacattactcaggttggtaagaattgccaggtagaggaaaggggagtgttttgcattgggctgatttaaaattatttgattaactgggctgctattttaggtttgtccttattaaatacttactgtatcatggtgggctatttttcatactttgttcatgttaatgttgttgcccagcctctgatggattgatttacagcagccaaacacatgaaaactgggtatacttgccatgaagaccactgccaatatatccctgtgctgatatgggatggggttcctcttgatcagcaccaaagattgcatgctgaacatatggaaaggaaattggacgaaagaagggtcaatgaccgctgttttcagatgtggcatggaagagactgatactggggaggaagcggcagggtctcactccttagccatgtgtatttaagaagaatgaactgtgaagaagttgatgatgatctaaaaacagagccccaaaatagtacatagaaagttaattacaacattggttatttgagagtgttggggacgtgggtggtttttatactactctgtctttgaatttaaaatagttttcaaaataaaatttgaagattaaagaattaaccagattttcttttgtctatatgagatgcatgcagtcgtttttagagatgagttccatccccactttgaatctgaagtattagaagaggcatgctctggtggacagtggggagttagcagatggaaggggatttagggaagggactggacattcttcctgcaagatggagcagtaagagaatgatgagagcttttagattcatgaaaaaggtgactctaggaggcttagaatgttccaaaggggcacttcagctaatagtcatattcagaagagtgttgtctggtttacacaaactgaaacttagggctttgaatcaagagtctcagcttctacttacaagataagcagttttggggaagtcagccactgaacctgtttcttcatttgcaaaatgaggataataaaatacctatctcagggtggttgtgagatcagttgtataatgtatgggaaaatgctttaaattttaattttaattttaatttccaaccactatataaaagttgccatgattgaaataaacaaaaaattgataagcaaaataaaacttacctgtttaaacatttattcattcaaaaatcccgagctcaagcaatcctcctgcctcggtctcccaaagtgttaggattacaggcgtgagccactgcactcggcctccttcaagtatttttaaattaatgtctttttttctgttcaaatttagtgtacatgttccccccaagagttgtaatgaaactaaaactgtcttttgcttttgatgcctttgttcaatatgaaaagcctgaataaatggctggatgtcttcatcttcaaatttaaaaaatgattcaagtatatattattgagttttattagaatggaaagctcttaatttcttgat

SEQ ID NO: 91292 - DNA, 447 bp, Homo sapiens
aatttataattaggaaggagtgggtatacttgccatgaagaccactgccaatatatccctgtgctgatatgggatggggttcctcttgatcagcaccaaagattgcatgctgaacatatggaaaggaaattggacgaaagaagggtcaatgaccgctgttttcagatgtggcatggaagagactgatactggggaggaagcggcagggtctcactccttagccatgtgtatttaagaagaatgaactgtgaagaagttgatgatgatctaaaaacagagccccaaaatagtacatagaaagttaattacaacattggttatttgagagtgttggggacgtgggtggtttttatactactctgtctttgaatttaaaatagttttcaaaataaaatttgaagattaaagaattaaccagattttcttttgtctatatgagatgcatgc

SEQ ID NO: 91293 - DNA, 408 bp, Homo sapiens
gacccctagacagatacagagagaacttcagagacaagtccaggctctaccatgtctaatctgtgactttgggcaagttgcacattctcatagtctctgatcttcattcttttaaactgtattagtattcccaaacccaggggtttttgaataatgaatgaaaatatttgatattaagctctacaaatgtaagtgacgtccatcattgtgatggcacctggaggccaactgagtcactgggagccttccttccctgtgagagtcctgggagtccaagtagcttttcgcacagctgtccaccttacatagacatggcctgtgctctcactcccagctttgtgcctggtattgttctgtctgcagctcctccctcccacatttctggtatttgagtattcccaagcagcc

SEQ ID NO: 91294 - DNA, 359 bp, Homo sapiens
ccaccccctccaagctggggagtaggaatttgcagtggtggtgctgggtgtactctgggggcaccaggggtctggaaagggcccagaagttgggtgagaaatgcataggggggacctaatttgttggggttttaaaatatatattttctaaagtttgggactcctataacaatttttaaaacctgtgtcttaaagctacatacacaaaagcagcggtcctctggctctctccccacgtctctaggcctgctctctaatgtgagctcctaggtatttaattcatcatcacctgaaatgtgcttttaccccctcccttaattcactgtatagcccctaatgactccttgctgatagctgag

SEQ ID NO: 91295 - DNA, 433 bp, Homo sapiens
attattttggtgacttctagagttgtgttggttgcaaatctctgttacaaccctgacccccaaactgtgtccctaggattggcttccttttactagaggtccctgtcccctgaagcacaacccttaatctcttaatatagtggcttctgagtcactcctgtgtttggcccccagggaaccctcagggcagctctgctgtccttttcttatttgccaggctttgcttctggcctgaattaattactgacttatgagggttaatggaaaccaggcagcctttttgagtctcacccaaagaagcatctgtttctcatctttaccatgtagggagggccgggggtagtgaagcaccctctagccatcttgcctctgccccatagctcccagtaagtggttcagggacaaagtgtgtgatctgatcatgtcaaccaag

SEQ ID NO: 91296 - DNA, 6006 bp, Homo sapiens
tggagttgactcttctgctcgcactgctgctgcagcacaaacgtgacttccaacattttttatttatctttcccttttcttttccaagatgtaactacggatcagacactaaggaccttcacgtttcgctgatgtagtttttggaggaaaaaggggggggagtgaagggcgtcggtttttttttgtgtgtgtgtgtatgtgtttcgggggaaattttccattatgagtgttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctacggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 91297 - DNA, 845 bp, Homo sapiens
tggagttgactcttctgctcgcactgctgctgcagcacaaacgtgacttccaacattttttatttatctttcccttttcttttccaagatgtaactacggatcagacactaaggaccttcacgtttcgctgatgtagtttttggaggaaaaaggggggggagtgaagggcgtcggtttttttttgtgtgtgtgtgtatgtgtttcgggggaaattttccattatgagtgttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgtaagtgctcctaacaacacatcctttgacttgcagttttaagcaatggctgtgaatgtcaagtttatagataattctgcctctgaagggttttaaacacagcgtccgataaggctgtttcttttttttctgaaagagggcttttcaagcaaagtggtgtctgcctagtttggttgaaaaaacagactggtgtagagatacctcaagtgaataaattgacctcgaatgacacaaccataatctacttttagatgaaaggcaagggattttggtggagcttgaggtggggggtggctgcggtaatgtaactaaactgcattctcaagcg

SEQ ID NO: 91298 - DNA, 5817 bp, Homo sapiens
tggagttgactcttctgctcgcactgctgctgcagcacaaacgtgacttccaacattttttatttatctttcccttttcttttccaagatgtaactacggatcagacactaaggaccttcacgtttcgctgatgtagtttttggaggaaaaaggggggggagtgaagggcgtcggtttttttttgtgtgtgtgtgtatgtgtttcgggggaaattttccattatgagtgttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctacggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 91299 - DNA, 6137 bp, Homo sapiens
tggagttgactcttctgctcgcactgctgctgcagcacaaacgtgacttccaacattttttatttatctttcccttttcttttccaagatgtaactacggatcagacactaaggaccttcacgtttcgctgatgtagtttttggaggaaaaaggggggggagtgaagggcgtcggtttttttttgtgtgtgtgtgtatgtgtttcgggggaaattttccattatgagtgttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagtgcccagctgagtccgtgtgaacttccagctgctgacgtcggtgggctctcagcagcgcttggtcgtggaaagggaaagaaaccaaacccggactgctggttcagggcagctgccggccggggaacaggagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctacggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 91300 - DNA, 5552 bp, Homo sapiens
cacgaggcgagaaccgcagcccgactcccattccggactcgttgaggtggagagcagcgtggggatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctacggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 91301 - DNA, 5573 bp, Homo sapiens
attcgatctgcctttctgcacaatacaaaagcaaagtccttaacacaagccacagatggcactctgattcggcttgcaaaaaaggatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctacggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 91302 - DNA, 3434 bp, Homo sapiens
gaggctggctgtacaaacggagcgctgctgatcgacgaacagagatcctgtacaacactcaaggggtcgttgtaaagccagactcgtagaacgacttaccaccacgttccaccctctgctcaggctattgagcccaataaatggtctcactcctacggacgtttgctccccacggaacaggcgttcctgcaagccatcgcatctacggacgcgtagtagcctagagtccgatattaaaagactaggtgggccgtcgtactacacaactctcggagactaggaagtggtcctggcagtaggggcacagacgtacatcggcttcatcatgtcttccattgtactctataaggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctacggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 91303 - DNA, 3026 bp, Homo sapiens
gctgctttgagctgagttctgaccagcttctctggcctctgctgaccctgccggtcccgcctgtccatcttagagaagagatggacgggggactcctttgtaagcccagcctgtgggcctgtggcctacttggctctggagatgagcccggcagcctcctggttgtgtaaccttgtcctgtttccagccctggcattgccacgtggggacagaggggcctgtgtggtcatcatgtcctcagctgtgcatgaacctgtcatcactcttggaccagtgcagtttagaagctccttcttgtgttatgaatgacgtctttttattttccacataaaacaatcttatctccttgagagcaggcctcttagggtgcgcatacgtcacctgaagactgcaggtgtccctgcgcacagggaggggtgcctcagcctggccctgtctccccagatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctacggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 91304 - DNA, 1344 bp, Homo sapiens
aaaaaaaaaaaaaaaaagcatatacaatagacaaacataattcatacagtgtgacaaatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 91305 - DNA, 3843 bp, Homo sapiens
tggagttgactcttctgctcgcactgctgctgcagcacaaacgtgacttccaacattttttatttatctttcccttttcttttccaagatgtaactacggatcagacactaaggaccttcacgtttcgctgatgtagtttttggaggaaaaaggggggggagtgaagggcgtcggtttttttttgtgtgtgtgtgtatgtgtttcgggggaaattttccattatgagtgttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagtgcccagctgagtccgtgtgaacttccagctgctgacgtcggtgggctctcagcagcgcttggtcgtggaaagggaaagaaaccaaacccggactgctggttcagggcagctgccggccggggaacaggagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatggtgcgtccactcagccaccgcctccagcaggagctgtaggacctcctaggcacttgaacatggtttcccatgaacccgcctttcaaaggcaatgaggacacagcaaaacaaatccccagggtgcaaagggaaaggtcctctgacacaaaagccaaactgaccttccatcagattgcacagggcgctggggttttgcacggcctttgcatctgttttggggcttgtttgtgttgtgggctgctgtgggccctgggatttcttgtgcccgccgctcctaccttctgggca

SEQ ID NO: 91306 - DNA, 352 bp, Homo sapiens
gctgagggattctgcctccagcacaagctgctttttcagcagagccttggaggggccttccgcgcttctgctgtgcgtccgctcagggcctctgggcggcagcctctgttcctggcagaacaatttggccctcatggggttgatccttggtggagtcttcccactcctcttggcactgcgggttcttagagaatatatttcttccttctctgcctgtcattaactcagaatacaaggtggcccacagccgcagggacgccaaggggcagcggcccatgacaggtgtctggcctcatttgcagtagggttcagctttgcttctgaagctttactgttttttgttttgtttcag

SEQ ID NO: 91307 - DNA, 249 bp, Homo sapiens
cctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcataggtaggtctgggcggggggtcagggggtggtgcctgccctcctgcccccagatccctgcagttccctcacagtcttca

SEQ ID NO: 91308 - DNA, 370 bp, Homo sapiens
tgatgtgatgtatttaagtgtttgtccccttttctcacctgtagggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggttagtacccaaggctgaaaatattggtaccttcaaccagggactgcaaactcaggtgccagttttcaccacatgataacgtgagcccattcacccaatctcttgattttcatagaggagccagaatcatgaggtttcgtatcaaatgccctgctttctaagtattgtctaataattataatta

SEQ ID NO: 91309 - DNA, 538 bp, Homo sapiens
  misc_feature (337)..(337): n is a, c, g, or t
  misc_feature (344)..(344): n is a, c, g, or t
  misc_feature (406)..(407): n is a, c, g, or t
  misc_feature (410)..(410): n is a, c, g, or t
  misc_feature (426)..(426): n is a, c, g, or t
  misc_feature (439)..(439): n is a, c, g, or t
  misc_feature (441)..(441): n is a, c, g, or t
  misc_feature (443)..(443): n is a, c, g, or t
  misc_feature (457)..(457): n is a, c, g, or t
  misc_feature (468)..(468): n is a, c, g, or t
  misc_feature (474)..(474): n is a, c, g, or t
  misc_feature (478)..(478): n is a, c, g, or t
  misc_feature (481)..(481): n is a, c, g, or t
  misc_feature (495)..(495): n is a, c, g, or t
  misc_feature (505)..(505): n is a, c, g, or t
  misc_feature (520)..(520): n is a, c, g, or t
ccagtgattctcaaactttagcacatatcagaattatctaaaagtcttattacatgtcaggttgctggtgacccagagtttctgattcaataggtctgggatggatacagaaaatttgcatttctaacgagttcccaagtactgtgatgaagctggttcaatgatcacactttgagaaccactggcctagaccatgttttccattctcaaaaagttccattaagttgtttttcttggcttcccacccttagaaacaggtagaagcttcaaattatactttttttttttttggtagagatgagatctcaccatgtaagccagattggtctcaatctcntgattcngtgatccgcccgcctcggcctcccaaagtgctggaatcacaggcttgacccaccgcccccgnnaantcttcaagtttgcctnaggaagtctagantngnagagaagctctcanaccagaaaagnaatagntcanggnaggagattattgcnattcaggcancagaggacagaccanaaaaggaacttgtaaatt

SEQ ID NO: 91310 - DNA, 505 bp, Homo sapiens
ccagtgattctcaaactttagcacatatcagaattatctaaaagtcttattacatgtcaggttgctggtgacccagagtttctgattcaataggtctgggatggatacagaaaatttgcatttctaacgagttcccaagtactgtgatgaagctggttcaatgatcacactttgagaaccactggcctagaccatgttttccattctcaaaaagttccattaagttgtttttcttggcttcccacccttagaaacaggtagaagcttcaaattatactttttttttttttggtagagatgagatctcaccatattgcccaggctggtcttgaactcctagcctcaagcaatccttcagccttggcctcccgaagggctgagattacaggcgtcagccactgtgccacgccctcaaattatacttgttacagagcttttctggatcaaattacataggcaaaaaagaatttattatgctgactatttggtaacaaagaaaaggaaa

SEQ ID NO: 91311 - DNA, 443 bp, Homo sapiens
gaaatggaattaatttatgatgaatgtgtgttcttttagtctttatatttcttcacaagaactcttgcatataataggtactctatagatatttgttgaataaatgaatgaattgtattttcccataaagatgaaatgcattttttatttgaaaagaaaatataaccagcaaatgctacccttattatcctatttttctctagatttgagggcttattcattatgaccacagcttatcaactttgagatgatgaataagtgaacttgtcttaatttgggtatttttatttatgtaagaaaaaaacataaagtatagaaaatgcagaattgtacctgaggattataccttctgataacgcaaacaaatttaggtaaaatgtagatttaaaaatgtgagtattactggtgtcagggaaccccttttgttcagcttttctgttcac

SEQ ID NO: 91312 - DNA, 398 bp, Homo sapiens
cgatctcggctcactgtaacttccacctcccaggttcaagccattctcctgcctcagcttccaaattagctgggattacaggcacctgccaccacgcccggctaatttttgtatttttagtagagacagggtttcaccatgccggccaggtttcaccacgcccggccctatgttttcatttctattggataaatatttaacagtgaaatcatgggtttacatgaaacgtgtatgtctttttcatgtgtgtttaatttttaaagaaactgtccatctgttttccaaagtgattgcactgttttacatcccaccagctgtggcttagatttccagttgctccacattctccagacagtgaatactttcacatttcagacattctagcatatatagttatt

SEQ ID NO: 91313 - DNA, 1915 bp, Homo sapiens
tgcacttttacttgggcaccttgtgaccgcgaatcaattaaatgtaaaagtattggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaagacggagtctctctctgtcgcccaggctggagtcagtggtgccatctcagctcactgcaagctccgcctcccgggttcaagtggttctcctgcctcagcctcccaagtagctgggatttcaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 91314 - DNA, 779 bp, Homo sapiens
  misc_feature (766)..(766): n is a, c, g, or t
  misc_feature (771)..(771): n is a, c, g, or t
cccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtaggcggcctgctcttgctcacccagtccccgctcactttcagcccactttccaactggaaaatctgctgtcccgcctccaggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaatanatatntgctttgc

SEQ ID NO: 91315 - DNA, 1510 bp, Homo sapiens
cccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 91316 - DNA, 1270 bp, Homo sapiens
cccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcaggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 91317 - DNA, 1889 bp, Homo sapiens
cccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaaatgcccctgggctgtctgaactctcttcactagtttctccgacagcagcttgcatttccaaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 91318 - DNA, 1814 bp, Homo sapiens
gctgcgagtcaggagggcagctccttctggaagcctggagctggtgaggccaggtgctttccctgctgcggtggctggcgatgggagtgtttcctgaggctgccaccaagcccctcctcagcatgggttggtgcgggaagtccttgagtgcctgtgggtcggcaggagctccggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 91319 - DNA, 1827 bp, Homo sapiens
cccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 91320 - DNA, 704 bp, Homo sapiens
  misc_feature (691)..(691): n is a, c, g, or t
  misc_feature (696)..(696): n is a, c, g, or t
cccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtctccaggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaatanatatntgctttgc

SEQ ID NO: 91321 - DNA, 1771 bp, Homo sapiens
cccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 91322 - DNA, 1676 bp, Homo sapiens
ggggcggggcggtggcgagccttcccaggggtgaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 91323 - DNA, 762 bp, Homo sapiens
tttttttaagctagtttaagaatacagtaaaatcttctgattgtgtttgtgaacactggtaggtttgttacaatgttaaaatattttacttctgtagaaagaaaaccaaatatatcacgatgactggatatttaagcttttaccagaacatttggaattgtccaatgccctctgttttttcttagagccttcatggtgctgattcacagtgaaccttcactacttagtcccagataactgattatcagtggttgaaatcaacgtggagatgtctcagaaaacctgttttatagaaacttctagaaagttgcaaaccaaaaaaacatgaatgtcatcatgtcatctcatttttctgtttttgaaaaattatgaagttttcagtaattgtgactttttaaacatgtaaaagtatggaagtacatccagtaaacaatgccatgtacattccccctcaatttcccaaccccatccccatttgctgtccagagtgtgaccacagttaacggttaatgtgcatcttttatgtacttaacatgtctgtaaatatgtcttttatctttttcccctcttttaaattttaacttgacgttaaagtttagaacttccatgttagtatgtgcagctgtaacacattctttttttagtagccacatagtgtttcaatgtatggatgttccaaaatacattacccatttcctgctgtaacattttaactttttagaattcaactatgtgtacttttgtaattaaaaatgtgaattt

SEQ ID NO: 91324 - DNA, 562 bp, Homo sapiens
atctattattattattttccatcatgtgaatctttgtcttaacagagaggcttcgtctatttatatttgttgttacaattgatttctttcatcattctgttatttcagtgtttctcttgaaaaataggttcttgttattcaatgatttagttttcactttatgtatcgttttctttattttgtccttcatattttgcaagctatatagcctctgttaaattccattaatggatatctttaagcactctttgacatgtaattttctaatgtctcagtaaataaagaatttgtcaacataaaatgtgtgtgtaggccaggtgcggtggctcatgcctgtaatcccagaactttgggaggccaaggtgggtggatcacctgaggtcaggattttgaaaccagcctgaccaacatggcgaaaccccgtctctactaaaagaatacaacacttagccggacgtgggggcgcgcacctgtggtcccagctacttgggagtctgaggtgggagaatcgcttgaacctgggaggtggaggttgcagtgagccgacatcgcactattgcac

SEQ ID NO: 91325 - DNA, 525 bp, Homo sapiens
gtgagccaccgtgcccaggtgagcatctgatttttatctagaaaaactggcgaagacaaaaggaggcaaagagaagaaaccaacattgatgaagcagaagggtcttatttcagatcttggctcttgtaagctgttcaatttcaggttatgtagagaactctctaggactcgatttgcttatggtaaaatgggaatctggataggatgtcaaattagcattaattaaaggagacgctataggtaaagctctcagcactcggcgagcacccaacatgtgatggctgacttctacatggtcatccaacatttcccataagccaggctctgagctaagtgctctacaaatatctcacagagcccccactacaatgacacaggcagcattagccctgctgcacagaggagaatgcaccgagaactgaatgaagtaccctttctgaggtcagtcagccaaggctgggtctctgtgacatgaaactccctttcttatctttttctcaatttccccacattgtactattaagc

SEQ ID NO: 91326 - DNA, 267 bp, Homo sapiens
acaccatactccataaatatgtacaattatgtgtcaactaaaagtaaaactttttaaaatgtttaaaaaactgtgcatagtaggaaatgaataaatatatattcttataggctcatgttgtaaaaagtgatggaagaataaacctttaaattttaataaaggttacctatgaggaaggaaggaacgaagggaatggaatggaaagggaaagaagctggacttttctgaatataccttgttttctgtgttggactttggaaccaataa

SEQ ID NO: 91327 - DNA, 366 bp, Homo sapiens
ataaaaaaaaaaaaaaaaaaaggaaaaaaaaaagccgggcgtggtggcgggtgcctgtagtcccagctacttgggaggctgaggcaagagaatggcttgaacccgggaggcagagcttgcagtgagccgagatcgtgccactgcactccaggttgggcgacagagcgagactccgtctcaaaaaaaaaaaaaaaagtacctgccctaccaatctcaacctcatggagttgcaagggtgtgatgagattatgagcaactgctttgtgaaaagaagtggagcttggtgggtgctccctagggtagttgaaaagcactggtgtcatagtccaggttcccccagaggttgacttgaaatggattcgagtc

SEQ ID NO: 91328 - DNA, 487 bp, Homo sapiens
agtggggaagagagtgaacatgcaatgggaagaagactgcaggaggagcaaccacccaactgtgacagcatcaccgcatctcatcagtgggagaaaagttaagcagcagtttcattccaaaggagaggaaagaacccctaatgatttcattgtactcattggggtacaaggtattacagaagccttcagaagctgccagtagatcctttctttctgaaacattcagggccttttggaggtaatcgatagcttaaatagaggattacaaagacaggttggaatttgagaacatatagagatacaaagagaggtaaccgtaactaagtcaggatcaggccaggcgtggtgacttacgtctgtaatcccagcgctctgggaggctgaggcgggcagatcacgaggtcaagaaatcaagatcatcctggccaacatggcgaaatcctgtctctactaaaaatactaaaattagctgtgagtggtggcacat

SEQ ID NO: 91329 - DNA, 168 bp, Homo sapiens
atccaagtgctccccacctcaggatatttactgttattgccaacactctgtgtacctgaaagtgccccaaagtgccatgatggaaaggagggaaagaagagaggggacggagcaagactgagagatgcaatctcacaattttctggtcataatggccattgaaatgac

SEQ ID NO: 91330 - DNA, 308 bp, Homo sapiens
gttccacaattattccatatcttgatagttgtaattaaaatcatgtatatttttacataataacaatatggaataattctatattgttgacactaacatgacaaaccacatggataacttctaaggaaagccaaatacagataagagacatttacatccttaggtagattaacacctttgaaacctcacaatctgaaatactaaaactatactctcttatttttcgccatgggatatcatgagcttctttttccttacgtatgtctaatatgagggtgttttggttaaatcaaagccttttacataaa

SEQ ID NO: 91331 - DNA, 494 bp, Homo sapiens
ttagatgttaggtagaaagtagggatcaacagtttaacaacttatgtttagatgtaactattcaaatgtataagaacaagtgtctcccctctaaaaatatttttaaaatctcacacaagactctaaaccaaaaaccattgtaaaaaatcctttggaaatggatcattgtagccattgagatgacaggtcaaggtgagcattctgaacatataacaaaatataagataggtgataaatattcaaagcatgaaggaggtataatatgaagagtaaagtcctcccctcatctccccaagcctcagtgctaagaacttatcatgtgtaatttctggttttgattcttctgacaattatctcacaaactctggaccagtgctgtaaaatagaactttctatgatgatagaaacatctaaatctgtgctgtctaatatgataggcatgagctacatgttgctataaatttaaattttaattaataaaaatgtaatacaat

SEQ ID NO: 91332 - DNA, 361 bp, Homo sapiens
aacctggatggctgcctgcagggtggacccaagaacagctttacggatatgaaaagtacagcagccaaatttagcaactagaaacagctagacgtcagagaagtggacaaggcaaaatactgcctgtccttaatgcctggaaatatttgttgaaatcttaaaagattagaaaagggattctgtttttaaccagggtacaatttttaaactaggcaatagtagcaactaaatgatatagctacacatcaggtatttgtacaaaatgttcttttgttttcgtgtgtgaaaagtgttttggtaatgtatttttctattcaatataggggtagctatattcactagcatattccattacttccag

SEQ ID NO: 91333 - DNA, 601 bp, Homo sapiens
atgtggcaaagcttttaaccattcctcaaaccttattaaacataagctaattcatactggagacaaaccctacaaatgtgaagcatgtggcaaagcttttaggcggtcttcacatcttagtagacataagataattcatattggaattcatactgaagagactgtacaaaagtgaagaatgtggcaaaggcctttactgctcctattcccttactaaagaatgtggcaaagcttttcaccagtactttacccttaatacacataagataattaatgctggagagaaaccctacaaatgtgaagaatgtggcaaagatttctattgattctcataccttactaaatataagataattcatattggagagaaattctacagatgtgaagaatgtggcaaaggctttaattagttctcatcccttactaaacataagagaattcataccatagagaaatcctacaaatatgaagaatgtgacaaagcttttaaccacttctcaaccctgcctacacgtaagataattcatactggaaggaaaccctacaaatatgaggaatgtctcaaagctttttactgattcttataccttactaaacataa

SEQ ID NO: 91334 - DNA, 357 bp, Homo sapiens
attaattgagacttttttaaaacagtagaataagaaacaaatgtgagatgaaactatgaattttgaggcatcaggtaaaaatggatcaagacattgagagctataacctccaaacatgaaagtttgtttgaaaatatctacaagtgcttacattgtttaataatcatacactttgcttgcctcaacaagaagttcaaaagtactattaaacaaatagaatttaactccagtttacagaattcatctataatacctctattagttcctttaaacaaaatttatctactttgtgaatgcaaagataactatggattattttgatagatcaaaacagaatgtccttcaaagtgttccctg

SEQ ID NO: 91335 - DNA, 460 bp, Homo sapiens
ggattgtttaaggccaggagtttgagaccagcctgggcaacacagtgagaccctctctctacaaaaaaaaaaaaaaagaaaaaattgaaaaaaccaaattagccaggcatggtgatccatgcctgtggtgctagctagtagggaagctggggtgtgagggtcacttgagcccaggagtttaaggttacagcgagctatgattgcaccattgcatttcagcttgagtgacaaagtgaaaccctgtctcaaaaaaaaaaaattactatatggcccagtacttccacttctacatgacagaatatgtctcaaatgcaaaaatgcagggacaggccaaagtgcaactcctgaaagacacatgacgtagcagcaaccatgtgggaggacataaagagaagcaaagagatttccaatggtgcagagagttagagactccatgaaatgaatcatcaacaagtactca

SEQ ID NO: 91336 - DNA, 474 bp, Homo sapiens
atacacaaaacattatgggtatttttgttcatttgattataaaatgccaaagttgttttataaatgctacttcaagcctggaaactttgaggaagtcctgaacattaagcatataaatggcccagctctagaatacatgtaagttgaaaagctaacctgaagtgggaagcgcagtatatacctaagacttactctgcactgaaagtttgctttgtcactagaagtaaaacaagactgtggtaggatagtaagatcagtaacacctcagttaatcaggtatcttggaggaagtgaagaaagaccctaattcaagggacagttaattggccttttattccaagaatgggccttagtggcagtatcttaaaagcccacaagatggagatgtttcctaatgaaaggcctttaatttctttatagagctgagttagtgtcacatcccagtccccacccatgacccttccccagttaaaa

SEQ ID NO: 91337 - DNA, 823 bp, Homo sapiens
tgagcaccttcccttttttcagccaactgctcgctcgctcacctccctccttggcacgatgagcacctgcagccaccagttcacctcctccagatccatgaagggctcctgcagcatcgggggcagcatcgggggcggctccagccgcatctcctctgtcctggccggagggtcctgccatgcccccagcacctacgggggggcctgtgtgtctccttctctcgcttctcctttgggggagcctgcgggctggggggcggctatggcggtggcttcggcagcagcagcagctttgctagtggctttgggggaggatatggtggtggccttggtgctggcttcggtggtggcttgggtgctggcttgggtggtggctttgctggtggtgatgggcttctggtgggcagtgagaaggtgaccatgcagcacctcggtgaccgcctggcctcctacctagacaaggtgcgtgctctggaggaggccaacgccgacctggaagtgaagatccgtgactggtaccagaggcagcggcccagtgagatcaaagactatagtccctacttcaagaccatcgaggacctgaggcacaagatcattgcggccaccattgagaatgcgcagcccattttgcagattgacaatgccaggctggcagctgatgacttcaggaccaattaggagcacgagctggccctgcggctgactgtggaggctggcgtcaatggcctgtgccgggtgttggacgagctgaccctggccaggactgacctggagatgcagatagaaggcctgaaggaggagctggcctacctgaggaagaacc

SEQ ID NO: 91338 - DNA, 512 bp, Homo sapiens
caatcagacaggaagaataagttctggtgttccattacacagtaaggtgagtacagcaaataacaatgtgatagacatttcaagatagctagaagagaagattttgaatattaccacaacaaataaatgataaatgcttagtgatggatataattaccctcatttgatccttatacaatgcatatatgcactgaaacatcacactgtattctttgtctttctacaagtattataggtcaactaaaaacaaaaaatttaaaaagaatgtaggctaggtgtggtggctcacacacataatcccagcactttgggaggccaaggcaggaggactgctcgagcctaggagtgtgaccagttcaggcaacatggcaaaaccccatctctactcaaaaaacacacacaaaaaaacttagccaggtgtggtgacacacacctgtagtcccagctactcccagctactcaggagggtgaggggggagcatcacttgagcccagtcaacaaaaaaaaaaaa

SEQ ID NO: 91339 - DNA, 377 bp, Homo sapiens
tcacaatataaaatgacaagaataatgagatcttccacatctttttatatttttccactatatttgtgttaaagcttaggtattattttcattctttcatgctaaaagcacattagcattttctagaatgtaagtggttttgctagaaaaatgatattaatatgattatccagattgttattttggagggaaaaaggaaataagttctgcaaacactgttgggtttcttttttttaatgatagaggcataagatgaatagtatccatcttcatagaaagaaagaaacgtagagccaagtattgaaattttttaatggcatatttctttgtggaggtgaaaactgtttctttgcatttaatatgcacatctgccttgt

SEQ ID NO: 91340 - DNA, 2887 bp, Homo sapiens
  misc_feature (1530)..(1530): n is a, c, g, or t
  misc_feature (1586)..(1586): n is a, c, g, or t
  misc_feature (1630)..(1630): n is a, c, g, or t
  misc_feature (1707)..(1707): n is a, c, g, or t
  misc_feature (1738)..(1738): n is a, c, g, or t
  misc_feature (2052)..(2052): n is a, c, g, or t
gaggaacagtctcaagcccaatttctagaccagcacttgtcggtgggatgtgtgaagttattcaggaaagacactgggacaaacatctcattgggtgccagtgtccctgactctttagtgggcttgaagtggggctgagtgcctgcctcaggctgcatggagctgaggggaggcttggaataaagtctcagttgggcatttgatttcacagactcagactcagtcctgggggaaaaattactaacaaacaaatacactaacaacaacaacaacaaaaaacccctaaggctatcacaaactcagaccaaacccagagcctgtcctccttccccttccttcctttgacctgtactctttccactgcttctaaaaggtacatgtgtggagagggggttgttcccattccccctcattctttctttagcagctgattcccacgagcccacattccagggaagatggatctgccctccttcatatctcgctgcccatttttgcaggtgttggggctactgcagggcctgctgcttactagaaaggttggagggctctgtgggtcctggcaggctgcaggtttctctctggagacattccagagctttagaacaaacatgcagacagtcttacagctgcagttgcctgagccttaagggccttgctactcaaagtgtggtcctcggaccgccagcatcagcatcacctgggagcttgttagagaaaacaaatctcagacctcaccgaccccacggaatcactatctgcattttaacgacatctccaggtgattcatctgcacacaagttcaaccacaggctgaccatttagagaagctggacttgagtgggattttgcagtttttccttttgatggcctcctcccctttgcttcccctcctacccttctgactccttgtagcttattttagaacatgtcgggatcctgcttctcttgtcaacaaaaggctgttgttaaaatctttcagccggcagcagcaatgtttaattcatggactagaaaattaattttattttcatgaatagagctgaggaaaaatagcaaggagactctgtgcatggcccttgggaatccagcttgtctatttaacagatgaactggcaacagtggggaggcctgaggggagggctgccttctacaaacttgtgtagcaaattgtattaggatgcttttggctgcaggtatcacaaaattcagcttcaaatggcttaaaagaaaaggaaaatttctaatttcactgataaaaaatcttgagatagggtacttttaggatgacccagaaatgccatcaaatagcaggtttgttttctgccatggtggcttgttgcattcagttttcctcatggttacaaggtggccgccagagttccgggcagcacatggagtcaatgtcctatggaaggagaaagaggctgcccctccctgaagtttcattttatcagagacaaaatctttcctggttacctcacagctgatcctcacagctggtgtcctcttaaatctcacttgtggccnggtaatggctcatgcctgtaaccccaccactttgggagactgaggtgggtggatcncttgaggccaggagttccagaccagcctggccaacataacgaanccccttctctactaaaaatacaaaaattagctgggagtgatcgtgaacacttgtaatcccagttactcgggaggctnaagcacgagaattgcttgaacccaggaggcngaggttgcagtgagccgagatcatgccgctgcactccagcctgggtgacggagcgagactgtcataaaaaagattttaaaaaaagtctcacatgtaggattgtgtcatgcgtcccttggtaaaccagtcattgggaaggggatggattactatgggtggctcagcctgatcagggttggacactttcttcatctgttgaggatactataacagagtaccacaaactgggtgacttttaaatggaagaggaagaaatttatttctgagttctggaggctgggaagtccatgaacaatgcatcggtagattggcgnctggtaaggacccacttccttattcatatatggtgccttctttctgtgtcttcacatggcaaaaggggtgaagggtctcttctctctccagccttttaaaaagtattgattgattgattgattgtctgacagggtcttgttctgtctcctaggctggagtacagtggtgcactcacagcttactctaaccacgaactcctgaactcaagggatccttctaccccagcctcccaagtagctaggactacagaggcatgctaccatacctggttaattttttacgttattatttttgtagagaatgagggtctttttatgttgtccaggctggtctcaaactcctagcctcaaatgatccttccacttcagcctcccaaagtgttgggcttacaggcatgagtcactgagtctagcccaccagccttttcttagtgccttagagggcactaatcccattcctgatggttccatcctcatgacctaattacctccccaaagccccacctcctaataccaacaccttgaaggtaaggatttcaacataggaattttggagggaagacaaacattcagaccacagcagccactgagtcacatgaggcaagggcaaaagagccaaatgaaacagaggctctggctcgaaggaagcggagggcgtggctgctgagacagccaacacctcttccaaggccttccttggtgttgcctccattccctggaaaggtctggctcctgtgttttacatttcagtgtgctcttcccagtagagcggtaggttactctgggcacagggaatttttaaacacccttgtgggagggttcctggaactgaatt

SEQ ID NO: 91341 - DNA, 567 bp, Homo sapiens
gttttttttattagtccatctagccagaggtttgtgactcttttggattgtttcaaagaaccaacttttggtttcattgattttgttgttgttgttgttgttgttgtgttctctgttttatctttgctctaatctttattatttccttgcttctgatggctttgggtttagtttgtttttctctttctagtttcttaaattgtaaagtttcgtttttaatttcagatcattctcgtttttttaatgtaagcatttatagctataaatttctccatgttggccaggctggtctcgagctcctgacctcagatgatccacccacctcagcctcccaaagtgctgggattacaggcgtgagccaccgcgcccagccgctacacctttcttaaatgactctaagactgtttacttacagtcctcagtttttagtaactttagaattactcatttatacacatgcactgttcattcatttatacaaccacacataatgaaaacttattttttccacagataatgtatttctaggacctggacattagctgaactcttgatataaaaaaaaaa

SEQ ID NO: 91342 - DNA, 406 bp, Homo sapiens
atatgaaatgtttaaagtaacttaaaacttttaggtccaagggtctcaaactgtagggaagattcactgaggtgggacttagaagcgcacattcctaaccaggcctccagaggcagaggagcctcctagggatcccgctgagatgcgaattctgactcagcagatgtggggcgtggcctgagagtctgcatttgtaaccagctcccacatgatgtggatgatcctgatccagaaccacactgtgaggatttttaactgccccaaaaactccttataaaaacgaggctgaccaggcgacgtggctcacacctgtaatcctagcactttgggaggctgaggcaggaggattgcttgatcccagggctttgagactagccctgtcaacataggaagacctcgtctctac

SEQ ID NO: 91343 - DNA, 978 bp, Homo sapiens
ggtgtatttaaaatcccttagctagacataaaggttctccaaggccccaccagactcaggagcccagctggcttcacctagtggatcttcacagaggcagtaggtggagctgcctgccagtgccgtgcgcccgcactcctcagtccttgggtggtcgatgggactgggcgctgtggagcagggggcggcgctcgtcggggaggctctggctgcacaggagcccacggaggggcagggggaggttcaggcatggcgggctgcaggtcccgagccctgcccgccagaaggcagctaaggcctggcgagaaattgagcacagcggctgctggcccaactgctaagcccctcactgccctagggccggcggggtccgccgctgctccgagtgcggggcccacggagcccacagccacctggaacgcgcgctggcccacaagcaacgcgcgcagcccgggttcccacccacgcctctccttccacacctccgcgcaagctgagggagccggctctggccttggccagcccagaaagaggtcccacagtgcagcggcggggtgaagggctcctcaagagccgccaaagtgggagcccaggcagaggaggcgcagagagcaagtgagggctgtgagggctgccagtatgctgtcacctctcactacactccagcctgggtgacagagtgagacccggcgacaaaaaagagggagagaaaattgaaagactttcctaaagtcacgagttatcaaatgccagttagcccggtctaacatgacactgaatcaactatgtgcttcctgctcaggagtcagaacgatattatcaagtgttaatgcttctaaatgcaaagagggagcaaggtgtttcttctctttagtctgtgaccagcagctgctcactataacctctcttccactgcatgtccaaggattactgcatagaggaggattcccatcttcccagcccctaaatttaaaaata

SEQ ID NO: 91344 - DNA, 525 bp, Homo sapiens
tgctgaggataattttcagagcagaatgaaatgaatggctaccacagaaattcaaatcactcttctagttctgggccatgtgtcacttaacatgaaaaagaagaataagtcttagcaaaataatagtgagtaaaaaagtagtaagggaaataattgttcacttaatgttaagtgaaaaaaaatcagaccccagggatggataaaatcatgattcccccctttttttatgtcatagaaaatacggccgggtgcggtggctcacgcctgtaatcccagcactttgggaggccgaggtgggtggatcaccagttcaggagatcgagaccatcctggctaacatggtgaaaccccgtctctactaaaattacaaaaaattagccaggcgtggtggtgcatgcctgtagtcccagctactcgggaggctgaggcaggagaatggtgtgaacccgggagacggaggttgcagtgagccgagattgcgccactgcactccagcctgggcaacagagtgagactctgtctcaa

SEQ ID NO: 91345 - DNA, 199 bp, Homo sapiens
ttagtggttcctttagggtttatagtatataactttaatttatcacagcccacttcaagcgtaagataagaacttcatgtacttctattcccccactcgagtctgttccctattattgtcatgttttacttctacacatgttaaaccttataatacattgtgggtttttgtttgtttttgatacttttaaagtgatata

SEQ ID NO: 91346 - DNA, 1007 bp, Homo sapiens
ttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgctctctttagcagatgatctgtaatttggtcattgttctgttatattccagattgctctacttgctaatatttgtatagaatagaatttatgtaaactagtaaccagttgatctctgtgccaaatacattatatcaggattacacaaaaagtatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatccagaa

SEQ ID NO: 91347 - DNA, 225 bp, Homo sapiens
ctgggaggcggaggctgcagtgagccgagatcacaccactgcactccagcctgggtgacagagtgagaccctgtctcaaaaaaaaatttttttttagcaaaccagtaatagaaaggatttacttcagtctgataaagggcatctacaaaaaatctgtagttatgtcatacttaatagtaaaggagaaatgcctcctccctaaagtttggaacagtacaataaggc

SEQ ID NO: 91348 - DNA, 255 bp, Homo sapiens
ggctttccacacaccttggctctatgatcgtgtatcactgcaaccaccacttccatcttcgtattgcctgagtctgacgtttcttcttcccacttataaggacgcttgtgattgattccatcgtgcccacctggatgatacacgctcctctgcccatctcacaatccttactcccaaggcccctttggctatgtaaagtaatatactcctagattcagggatttgaatgtggacatctttttttttttttggaaa

SEQ ID NO: 91349 - DNA, 236 bp, Homo sapiens
atccactttcctgggtccaaagggagatttcatcaaactttagagatggagcagaggaagagggaagtttttatttattagcagttatttattaagcccccaccacgggcctgtactgggtactgcaaactgagtggtgaatggtcagatgtagcacttgcctgcatggaatttacagacccagactgaaggattaaaatgaaaacaggggtagcagagattggagcaccctccag

SEQ ID NO: 91350 - DNA, 120 bp, Homo sapiens
ggtaagaacaaggttttatttaaaatgttgacttctcttaatacaagaaggtgttaagttttaaattctataatctgtttcttttgaaattcctagattgatatctcagaatttcagatc

SEQ ID NO: 91351 - DNA, 435 bp, Homo sapiens
aaaaacctacaaaacttgagtgttagctgtgtatgtaactaaagtttgttacttaaagtacagtgtagtgtcatagatacaaaataagcaagataggccattaatagttccaaatttcttgagaatagggattgtgcatgttttatctttccatggaataaaaagtaagtattgtttttaaaataataccaccattaaatgtgttgttaataacattggggttttgccattaagagtaattgagagtaatggcaaaaaccgcaattacttttgtacccaatgtattaatgattatcttcttccttcttgatttagtattattgtgaaggggtagcatggaaaagaagtagcaataagcaaaaaaaggaaattcacctaaacatttctgtgtacctaggtaaccctaacttaaaaataccttttccatacaaatgt

SEQ ID NO: 91352 - DNA, 292 bp, Homo sapiens
ggcaatcaatatctattctctatcactatagatcagatttgttttttctaaaattttatagaaacagaatcatacagaatgtactcattgtgcttggcttctttttatcaacataatgttttttgagctcatttatattgtatcagcatttcccttcttattgctgagtagtattgatatatggatacactacaatatgtttttccactcatctgttgatggacatttgggttgtttccagtttgggctattatgaataaagtacctaaggcagctgtaacaaattactgca

SEQ ID NO: 91353 - DNA, 362 bp, Homo sapiens
aagattgtgccactgcactccagcctgggtaacagccagaccctgactcaaaaaaaaccaaaccaaaaccaaaatggtaatggtagtagtatctataaccaagacttgtagaaaattgggtaactttgctaagtgtctggcatatagtagatgcttaaatggtagctgtagttaatcgtaaatgatttacccctttctatgctaacattttggctcttaaaattatttgaaaccaactatctgatgctgaccagttgccatctaatgaaaatgacagtttgagaggttggcctcaagccaaccaaatcagagagataagaagattaatgctcttccttccctagtatttttctatacccagg

SEQ ID NO: 91354 - DNA, 1169 bp, Homo sapiens
aaaaaattagccaggcgtggtgatgcgcgcttgtaatcccagctactcaggaggccgaggcaagagaattgctggaacctggaggcagaggttgccgtgagctgagatcacactactgcactgcagcctagacaatagaatgagtcttcgtctccaagaaaatactagccagtattataaaggaataaataaagctgtcattgtttgcagaagtctatgtagaaaactcaagagaatgtacagaaaatcttttagaattaatagagttcaccaggatataaaattaacatacaagtgcagcatcaaagaggaaatgtaatgttaaaaaagataccattgataatagaaaccaaaatgtcaggtactgcggaatcaatattacgaaatatgcatgtaactttagagaaaaataactgatattttagcagacctcaataaagatgtatttatatataggaagattcaagcttctgaagttgtcaattctccctttaataatctataaattcagtataattctaataaaacttccaacaggaatttatttgccctttgtaagtggatgctgctgtggccacatttgaagagaggcttggcctgaggatttgctctaccagataggaagttatcttatttaaaatagcagtatttggccaggtgtggtggcttacgcctgtaatcccagcactttgggaggtcaaggcaggcggatcaccggaggtcaggagctccagactagcctggccaacatgatgaaaccttatctctactaaaaatatagaaattagttgggcatggtggcaggcgcctgtaatcccagctactcgggaggctgaggctggagaattgcttgaacctgataggcggaggttgcagtgagctgggattgtgccattgtactccagcctgggtgacagaacaagattctgtctcataaaaaataaaatagcagtattcacgcagggcagtgatatggcccaagacggggcccagaacaggctctcgagcatgtggacatggatgggaaagcgctgcaggccagttgcgtgggaggtctgcactggacgtggtgctgggaccactgtgatttatgaacttggccagcatgggagaggagctttgtcaccatgggagagggaaggatttcttaaataagccaaactaataac

SEQ ID NO: 91355 - DNA, 364 bp, Homo sapiens
taagaattcaataaagtacctgtcacaatgctaatatataagcagcagcagctctcctatatacaaattacaagtagaaaatgtaatgacatgcatatgtgtgtgtatatatatacgagatgtatgaaatgatgattgccaagctattaataattattcatgtacagtggtgaggtttcaagtgatttttactttctttctttatacctttatgtattgttccaaaaaaatgtttacaatggacatgtattttatgtaactttttaaaaagttacttctattgtaagaaaaaaataaattgcagtagaagaacccagttataactgcaagataaatatataacaattagaaataaatttaacaa

SEQ ID NO: 91356 - DNA, 470 bp, Homo sapiens
tgctgatgatgcagaagattaagaagaggagcagtgccattgatttggacacgcgaaaaatttgcagcagatcttggggcatctatagcctctgcaagttgcaagtgttaaagataatcaacctcagctaacatcctttgattgaaaaaagcttctgtgtcatataagggaaaatatgctaatgaacactaaggtttttttagggattcaaagaaaaagaactagcttcctaaaacaatgcttctaactaaatatctgcaaatatgaagacatacccttcaacacaaacatcttcagccctcaagctgaacagatgctgacattagtattagcctcctgcaaagagtcaacatcttcaatcagaacctgggtcttccaacatagatgaaggtcttgatgtcctgtcaagattcaagttagcctgaggtctcactgtttatctatgatgccacacatctagtcacctctac

SEQ ID NO: 91357 - DNA, 505 bp, Homo sapiens
aaaaagtcagcaatgaacattgtgatctgagtgaggataggagctcggggagtgcctccaagcccttgtactgcctttcccatctgtttttcactttctcccattcccccaagtacttagtagagttttccattaagctccactgaactgagccattctcagcaaaataactccacaggttatttattgcggttcaaataagttccaaatcaaattctgtgtcattgaatatcatttttaaattccttcaagtcagattggtatattacattgagtttgtcatatttaaccaacaaactaaagctaaacattttccaaaggaaaaaaacaaatgctgaaatacaccacttggattttatttaatattatttaaaataacattaaactagaacatgtggacataaattctataactaaacttactgatttatgtatcatagaaaagtaataaaacaactctcttctaaataaaggcttatttacacaatgttaaatggtcagaaat

SEQ ID NO: 91358 - DNA, 399 bp, Homo sapiens
cggagagagaacccagggtcttgctctgtaagtgtcacgagagaccctttggatccttcataattcctgtgaccagacctctgcctccccagtacctgtcccctccacccctgaagaatctgctgtctcgggaaactccagaatggagctgggccagtgggagctggatgagatgacctggctcctccctgagtcacacccaatccttgagcaatcaggtcccaattccacagacagttcttatggtccatcccatgcttttgagagagttatggaaatcctcctctttctgctatgtgggttggggtctactttgttcttaaagagccctccatattcttttttatccaaaagttattacatagtttaggcccctcctgctgcagaaaaggactgtct

SEQ ID NO: 91359 - DNA, 835 bp, Homo sapiens
cctaaaatcagattgagactcatcagtgctaagttagagagatgggattatatagtctgtaagtgcccttcaaatcttgagagctcctgtattttgtgtttttacagagtattttgtttaatccctatttcaaccctataaggtagatactatccttgagttttcaaatgaaaaaaaaaacaaaaactgagattctacgatattcagtaatttccccaaaatcccacagcaaatgacagagctaggatgggaacccaggagtcagaaatcggaacttgtgttcctaatcacttaagctatatcacaaatgagagaggtggatgattctatgactgtagggctctaaaatgatgtgaaggaatgaaatgtcttcacatagacaagaaatgtctatgtcctaattcccagatcctgtgaacattactttatatggtgaacaacgtgattcagttaaagatcttgagataaggaacttatcctgtattacctgggtaggacctgcatcaatcacatgtattttttaaaagagggacgtttgacacagacagaagacacatagaagagaaggtgatatgaagacagaggcagagattggagtgatgcagccgcaagcaacggaatactggcagcaaccagaatctggaagaggcaaggaatggattctcctgctggagcctccggaggaagtacagccctgctggcaccttgatttgggacttccgtcctccagaaaagagagaatacatttctgtagtttcaagccaccaagtttgtggtaaagttttttacagcatccacaggaaactaataccagtggtaaagtgtactttacctc

SEQ ID NO: 91360 - DNA, 569 bp, Homo sapiens
ttggcaggatggccgggagcagggaagcacagaacatgtggggagactaacagcagcccagggttgctggagtttgaggagcgaggggtggtaggagggagagatcatggatgtgaggtcaggaagggggttgtggacagatgctgaagcactgtgaaaatgggtcttctctactttgcagacagagaggagccactgaatatttttcagcagctgagatgtgtgatcagataatgtttgtaagagataaatttttccctggtgatacgtacagagaacactcctagaatatctgctgctgatttctaagcagcagctttcactcatggcagttttttgagatgggttgttcaggcttcaccttcattaagtaataccacggaatgccttggtcccaagtgactgctgaaactggcccagttttcatgagtcacaattgtgtacatcagcaagtcctgcagctgaactgaaagcacccggtagggctttcagtggtgagacggagctagagtgaatctccctcactgccttcccataacccagcccgtactggctggaggaaatccaac

SEQ ID NO: 91361 - DNA, 274 bp, Homo sapiens
cagggaaagcaccatataatggattagtcaagaacgagatgaattggatggagcgtggaaaattatgggagctggtcagggttagcaataacacgctcagcagagtggggatggaggtaaacatggaaggatgcatgggatttgtataggcagaaagcaagagagcgggcacacctgatcaggtgagaggctcaaacaaaagcaggagaaccaaaaataaggaagaattagagcaccaaagaaatcagtttggttggaacaaaggatttaagaa

SEQ ID NO: 91362 - DNA, 430 bp, Homo sapiens
atatatatatatatatatacacacaaacacacacacacacacacacacacacgcacacatatgataatcagtcagtcggtaaccaaatgctagagagtgaccattaacctaagcctgtttttataatgaaaaaatgtgttaactttaaaatatgccaacctccttgtgtcttttaaacaagtcagagtgaaaatacattgtcccctaaggtgtggggagaggaagctttataataaaattagtgattctgcagaaacttgtgcactggatatcttgacaatatgaatataaaactccctaaattaaaaatagggttaatagaaattatcagtatttaaatagggaaaaatgattttatgtttattttatttaggttttatttctttggtcatcttaatgcaaaatgaataaagcatagaatctgggtttg

SEQ ID NO: 91363 - DNA, 156 bp, Homo sapiens
ttctgcaaatctagctgacaggtttttctacgactttctaattaagtctgtaagtgttgacatctttcttacatatgcgataaagagaaaggaggcaggcagccctgaaaatgaaaaaagaagtcagttttaaaaatgtggaatctacaggcagca

SEQ ID NO: 91364 - DNA, 812 bp, Homo sapiens
caggctcgggctggcatgcctcagccctgcccttctacctttgcagatgctgtttctccccggagcgactccctgccacctgcaccaaccccactgccaccctgcctatgccaccccacagcctggttctgcctgtgccttgcacccaccaggagctagctcgaggccctgggaggtgggtgctgctcacagcttgttcccagtgcccagttcacaacatgggcctcaaaatacaggctatgaatcagggctacacctctactggcaacctcagcataagactgggactcagacttcaggtctgcacagcactgtccactggatgcttccctggtggccccggggctctgcagatgctcagtttccaatgcacccgatccctgccccagcctcctccctgggccctgggcaccagcaccagcttgtcagaggtggcctccccacggcccgagccatcttctgacctgggcacatcccctccagccttcagaaaataccaaggtgctctgcttcttgctgagggcatggatcattcatcatcatgagtctgaagtccaaactccccagagtggctcacagggaaatattaaaatccactccaaggtcttaaggacaaattcaaactgcccgctctgtccgcgggtggaagcctccacactcctcaccaagatcctggacaaagtccaaaccccagttgggacccacaggctcgcatggggtccaacctcttctccagcctcgtcctttaccgcctcccacctctctcttttaccatcaatgggctatttttgtatttgtttaattggggtaaa

SEQ ID NO: 91365 - DNA, 212 bp, Homo sapiens
gttgggtttttttaaggcagtattaatttcattttctgttgtcaatattcaccataaaatggctttaaaatttgatggtttcattgatttggtttcattgatttttgcctaatgagtagtctactggctgtggttgatctgtgattgaatcttcatacactgcgcagtcgctttgtgtactgtatactagttgtccatactgttgaatatac

SEQ ID NO: 91366 - DNA, 367 bp, Homo sapiens
ccagcatttacccagctcttgtccctgctgccagcctgcaaggctccatctttgcttgaactgggtcaatgcacatccctctgtcctggtccccagctctttgtcccgtagtctgttccccaacagtgaccagaggaacttgtggatgcttgaactgggtcatgcacatcccccgtctgctcaggtcctcacagcagccacaggcagggcttgatcagctcccatcacttccctgccctcacctcctcctcccgttcccctccatcactccactccagccacaccggcctcttccctcaaacacacaaggcacggtcccaccttggggcctttgccctggctgtgtcctctgtctggtgcacccttc

SEQ ID NO: 91367 - DNA, 236 bp, Homo sapiens
catttctgttacattgagacttcagtcaccaacatctggtggcagagatacaggtgtatgaaacatttctatttacccaaatatgccagttcccaaataggatgactgcatttagtgttaaactggcttttctcattagatactctaattgaggaatatttagcttcttgaatagaaaccatccaaatgatgttttttttttgatatgtctgtaactataaaaatcagcaaataag

SEQ ID NO: 91368 - DNA, 362 bp, Homo sapiens
tgagcacctgctgttggaaaatggcaccaacagacttgctcaaagcgggttccagaaaccttccatttgttctgtaaaaatgtagtatctgtgaagcacaatcaaacagggtgtacctacgaacagagccatacagtatggagcctcccatgactggcttctttcccaacacaacctaccgtatggagtcggctgtgactggcttctttcccatagcatggtctcaagtttcatgcctagtgtagcatgcatcagtacttcacctactgtatggatatactatgctttaaaaatccattcattaggccaggtgcggtggctcacgcctacaatcccagcactctgggaggcaggtggattac

SEQ ID NO: 91369 - DNA, 237 bp, Homo sapiens
tctctgctaagattcagatattgtttatgaaatctcaggtgtttagagtggtaaaagaagcccatttgttcttttcaaaaaaggacataccagcctcaggttgaaaagtaaggcaaatatttttttgagttccttagcaactgttgaggtgatttctagataattttgaagaagtctgtgatgattggtaactactgagaattgctgccagctttgtgttaagaggtcaagtaccat

SEQ ID NO: 91370 - DNA, 488 bp, Homo sapiens
ccagaacctcaagaaggtatcttctgggtaactgaagtggataaccaaccgatcaggaagttccaagggccttccaagccccttctggaatgaagaatgcggagactcgatttccacctagaaacagagtcccacccctccctccttctcctcctggccccgggggtgcccagtgaagggcccaacagctcctagggcaccctgaccttcccccaggaagtgggagagaccagcggtaggaattgcaaatgacgttcattaagcaggatgctaataccatgaattacaaatgaaacccagatgaagaggaccctggcagccttacctctgttagatattaattgggcgacactttgttttaatggtacgttaattaatgcggaatttcgacggaagtcctcgtgacactcacattaatacaaacgaattcattactgtcggtgttattacaagaaatgacaaataaatctgtaacagtgggacccttc

SEQ ID NO: 91371 - DNA, 1292 bp, Homo sapiens
tggaatgattttttaaaacataaaataaatagaaagtcatattatgttcttaaataggaagcctcaatatcataacaatgtcaatcaattcttcccaacttgatccaaagactcaatgcaataccattcaaaatcccagtatcattttttgcggaaatcaataaactgactgtaaaaccaatatggaaaggcattattataagtcttttggggacctgccatactttatactaagaattattataaagcaaccacaatcaggacaaataatcaagtggattactggcactagaggagagagccgaactgagagtctagaaactgagcctgtgcatatactgacacttaatattcaccccaagcaagcactggagatcacaggagaaaaaatgcacctactcaataaataggctggaacaatcagttatctgttatcatatggcaaaaaaataaaagtggatccttacaaaaaaagtctttccatgtggattagagacttcaatgtaaaagtgaaaagcaaacaacttttagaaaatagagaattatcttaatgataggacacaaaaaaattttaaaacataaatcatagaagactgataaattcagctgcagtaagatcaagaatttcaatcaccgaagttttttttaatccaatcataaattggaaaagatatttgcaacacaaatctagaattagatctaggctaggcactgtggctcaaatctacaatctcaacactttgggaggctgaggtgggtagatcactggagctcacgaattcaagaccagcctggggaacatggcaaaaccccatctccacaaaaaatacaaaaattagccaggcacagtggcgcgtacctgtagtcccagctactcaagaggctgaggtgggaggatagcttgagcctagcaaaggttgcaatgagccaagattgcaccattgcactttagcctgggtgacagagccagaccctgtctcaaaaaacaagagaattagatctaaaaccataaaaaattgctatgaatcaatcaggaaaaattaaacaatccaaacagaaaaatgggcaaaaagtatatacagacacttcacagaataagaaacacaaatacatttcacagaataaataacacaaatgctctatgaatatccgaaaagaaactaaacctcattggtagtcaaggaaatacagattcaaattacaatgaaacaacatttcttacccaccagatacataatttttttttctttttttttagacgaagtgtcgctcttgttgcccaggctggagtg

SEQ ID NO: 91372 - DNA, 422 bp, Homo sapiens
tattaaggcaggctctaatttaaaattgccacaagctttctatgcacaaaataccagaagtcctaaagacataaatatgtttgactatatacaagagtaatattttatgtatcgaaacgctatacccatgttaaatgacaagtggcaaatgaaaaatatttgctacatgtgacagatcaatatccttaaaatataaagaaacctaaccaaaaataaaaataagaataaaataacactgtcaaagaaaatgaacaggcaattgaaaatataaatgaagaatatgtgaaaacattctaattcattagaattatagttcaaattaagataaaatctatctaccattcatacctatcaaattggtagagatgaaaatattaataaatgccaatgagtatcgtggaataagtgaaaaaatagagttc

SEQ ID NO: 91373 - DNA, 571 bp, Homo sapiens
gtcctgggtcctgagcttggagatcgctgaacgtgcctgcaggtgaccgtggcctctcctgaccagcagtgaaatgggccaaatgatgcttgcttgccctgggcactgcagaatcaatctctgagaacagctgagaagagtaacttctgctgtccctattcaggaagcctagttgtgttgattggggtcaccccagggttgctcaccagctccatggggtcagcgttgggaatggaaatgactcccttctggtggagacagagctttcagggaagcctgctaaaccagcacaagcaagtgcagccccttggccatcagggtgccgttgcaggacagggctgagctacaggttcaccttcctcacctgagtagcagctcttcctcctgcaggcctaggagagcaaattctgggaataccaaaaatgatgacctccccacccccaacatcttggggaccactttccctctcactatcccttcagccacagtgatgtcgcttacgtttcctgaacagaccttttttgtttgacttcaggaacgtcatgcaggctgttctttctgcctggaattg

SEQ ID NO: 91374 - DNA, 449 bp, Homo sapiens
agggagaatatgggatagaacaatttttttttaagaaataagtgctaaaaatttcccatattgggcaaaaacataactcacagaatgaaggtcagtaaactccaagtagaataaatgcaaagaaaatcaaatctagacatataatagtcgcactactaaagtccaaagataggccaggcgcagtggctcacacctgtgattctagcactttgggaggccaaggcaggtggatcacctgaggtcaggagtttgggaccagcctggccaacatggtgaaatgctgtctctactaaaaatacaaaaattagccaagttatggtggcaggcacctgtaatcgcagctactcaggaggctgaggcaggagaatcgcttcaacccagagggtggatgttgcagtgagccaatatcgtggcacttgagcctgggcaaaagagcaaaactctatctc

SEQ ID NO: 91375 - DNA, 462 bp, Homo sapiens
tttttttgagatggcgtttcactctgtcacacaggctggagtgcagtggagagatctcagcctccacctcccatgttgcctagtcctgggagtgggaatggggattcatatcaaaggagcaagagagaattgggggtagtgggtgggggaggagtgatggaaaaggcctaaatttgaatctgtacacttgtaatgggtgagtcatatggtatgtagattacactttaataaaggaggaaaaggtagaagaaggggcagagaagcaaacagggaggctgttgccccattccagatgacagacaacactgtcttgaccagggtggcagtgggaaggtgatgagaacggttagacagaatatattctggagggcatgctcaacaggatttatttatggattggatatggcacatgggagaagagaggatgacttaatttacttccagccttaacatctgtgtgaa

SEQ ID NO: 91376 - DNA, 414 bp, Homo sapiens
ctggagtctgcaggcagtgaggggtggggccaggggagggagtccagcagtttgcccgtaggcctggtggggagcaggtagagggaggcagtgggcagtgtattgtgggaagaggcctgcgtgcagccaccgccctctcttgctccttcccctccccctcttgctcttcatgctgcccctgcccagtgctatggtaaccagggctggctgcccagttccctcttggggtccaccccaacagggcctgcttttgaggacccacagatctcaattcctggttgggagccatggtaaccagggaatggataactagagaatgcggccccatggaccatggtttaggggcagggtctgtgcggaaaggagctggtcctcaccagctcccctggtccctcccaccctttccaccccact

SEQ ID NO: 91377 - DNA, 258 bp, Homo sapiens
ctctcgggttcaagtccttcctccacatttctgtccactcagcagcattcctgagggaagagtgggcaggcagggctatggtgaaggcatgaactggaactggagggcttcttttgcagaccctttgtggtactggaaagaaattcctcaaggacctataggctcattagtgccatgctaaactgacccagctgactctgaatttcagtagtattgttccagaaaaaaattccagccaggcatggtgacttacatctg

SEQ ID NO: 91378 - DNA, 457 bp, Homo sapiens
gtgggaatgtggtgtttcaaactcctgggagtatgagcttcttcctccacaacaccctcatcctgacttggagatgaggtctccatagcatttctacacaagaggttgaatttcccctcttgtttcattttagtttttgtctcctgagatttaaaaacatttttaagtaccacatttctatgtattcattagaatgcctggaaattttgtttcctgatagatttctctctgattatgttgtagctaaagcagcagggaaggtggggaacgaccttttctgcagggcagcagggagcattggacatgtcagctgaaagtgtgagggaaagaaccttggccttggagatggggagccctgggcaccggctctgcctctgtgactcacaatcacattcggccagcatactttacctccctgcttctcagcttctacatgttcaaaaaaaagaaaagaaaa

SEQ ID NO: 91379 - DNA, 275 bp, Homo sapiens
tccaagtgtgatctatgggccatagaattgcctaggttttattaaaatgcagattctcaggactcattatagcctttttgaatccaaatccttaagtgattatttttactgagtgaatggatgcatggaccagtattctctccaatttatagatacccagagtcctagcttgagacagttatctgtcctccgcttttatactctgaaacttcctggggctaagaagagaactgaaatccccaaacaccctgcctcaaatctcacaggtttccgtt

SEQ ID NO: 91380 - DNA, 216 bp, Homo sapiens
attaggtacagggactgttttaaggttttttgattaaataagacatataatatatctttgtaaaggatatatcagtgggagtatttaaatatcattattattactattacatgacacaaattggagaaatgggtcatgtttatcttttgaaaaatgtttgcagtagaatcatttaaaatgatccttttaacttccagaggacgtggcttttgcatt

SEQ ID NO: 91381 - DNA, 239 bp, Homo sapiens
acttcaccctttcaggcctggatgtcttcatctggataaattctaaccgttgttgaaaagccatgtggtaaatatttttgaaacctaaagccttctctacgcaataacactaagttttcatggtaaatgacacagtttcaatattctccctttcacattatggtcagtagtttgcattcgttgcttgaagaggcgaaatgaatagtctacagacactgggaaccaagtacagctcaatc

SEQ ID NO: 91382 - DNA, 1035 bp, Homo sapiens
gtggctaaccaggctgacaactgagatgaggattcactgtactcatttggtcacaagctgctggggcgggttttattttattttatttttatatttaagaaatgaaaatacgggtatttttaaagattctccaaaaagtccagaagccttgacagctggcatcaatcagcccaagacccccaggggattcatgggaaatgtcgtattttagagtcctacagaatatttctggcctcaaggaactggatgaagagactggacaaagtccccaggatgggcatcccccaagtcactacagcatctggagcccctaggagatactcagggaagcaaatccttgtttgggctggcaagcaaatccgacacgacgaggtccacaaactgtttctgcatcccagggctctgacgaaggcgttaagaaacagatgctgttcccgcgtaggctcccaggggccccagggaggtccaggtggactgcctctctcattcccaggagctgtcctgggactttgggatttcttctcagctttctccacctttcagtttctcagttgtttcagaaacatagcaatgacataaaaactgctatggagagaaagctaacatggtcccatgccttccaggcagccctgctgaaggatctaagttggccctgttcctgcaaatcatcaacgtgcctggactcgccagctaaaagcctgggccttccccagccttttttctggggcacctattcctctgccagtcctgctcccctcaccttccttgggcccgtcagagtcttttgtggtgctgtgcttctcagaggcaggatccaagcagatcagcccagcctagcccagctcaggcaggccatggccgctcaagggaaagactgccccagaagagcaagctggagaggctgggcaggggctgatggggctgggtacactggggaatgttagcaagactgggaaggaggccacattcctgtctgcagcagcccccagcgatggtcttcagcaataaaagttgtgtgacctgaaaaaaaaaaaa

SEQ ID NO: 91383 - DNA, 2101 bp, Homo sapiens
gaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggctttcttgggggcctcagagctggggaagaaaggaggaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactctttatgccaca

SEQ ID NO: 91384 - DNA, 2439 bp, Homo sapiens
ggttccgggtcgggtcttggaggaggccgtggggggagggcgggagctgcttcagtggatgcccccagggacccttgcccatccgggctgtgcctccctctggcctctgtctggagggagagactggttccttgtccggcctgggttgccacagaggaatcacagacccaccctaaactggggccccgcctcccttttctgtgccagcaggacttggacctaggacacctaggtcctgggtcccccgtgatggggagagaagtgttgcatcgcggatagactgtatgggctgagactctagggttccattttcacttatgaatctcgaggtgcatctggccttgggggacgatgatggaggcatgaagggacagctgctccttcttggatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactctttatgccaca

SEQ ID NO: 91385 - DNA, 1840 bp, Homo sapiens
ccatggaagatgatggcagcagaaatccttctatttccactcagctgaccaggactttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactctttatgccaca

SEQ ID NO: 91386 - DNA, 2202 bp, Homo sapiens
gaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaaaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactctttatgccaca

SEQ ID NO: 91387 - DNA, 1393 bp, Homo sapiens
gaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggctttcttgggggcctcagagctggggaagaaaggaggaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgacccctgtgaggaacctccttaccctgttctggaatcgctgccagactgtagcttttaatttaataaaaataaagtaaaatatgcaactctttatgccaca

SEQ ID NO: 91388 - DNA, 437 bp, Homo sapiens
gatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaaggtgacaatgagaactttgttattgcaggggctgctgccactttgttcacatccttaacagacttcagcagaagggactgagttagctctcaaggaaggctccctggcaataggggctgaattatttggcaatgtggagcaggcgaggagttggggagcataggaaatattccggtccatgtgatctgagggaggtggcaagaagacctccacctgtgtgggcgttt

SEQ ID NO: 91389 - DNA, 2221 bp, Homo sapiens
gaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactctttatgccaca

SEQ ID NO: 91390 - DNA, 2261 bp, Homo sapiens
gaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggctttcttgggggcctcagagctggggaagaaaggaggaaggttagcatgttgaagttccttcttgagcaacttggggagaagctgataatgggaatttgcagagaagagaggagatggaaggggagtttttatttctgggttggctgaggggaatggtaacatttgccatcataactttttacccttcccccactcccagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactctttatgccaca

SEQ ID NO: 91391 - DNA, 1641 bp, Homo sapiens
gaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggctttcttgggggcctcagagctggggaagaaaggaggaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggtaagaagaccatggcctgcccttaccctttggctttccccaagctctgacctaggaaaaccgggtgagggtgagtgtgcttgttagatgtgagacagtcttgctgtcttccactgtgccctcctactcagtgccctggacctaggaggtccccgtgaggcccagcctttccatccctgtgatcccaaggcacacgtgaaaatcagatatgagctaggaaaaaaaaaagcaaatcagatatgagaggaaggaattgcatattatttccttgatgaacacaaatactgtgctgacatcttggcagaggtaaattctgtggaggtggtggcttaggggaagggaggcacaataggaagggatctgaccaacccaacagagccaggagcatcactctgtaaaaacaggagtagtcaaggcctataggtgtcttcctgctggacaaagagtaatgtgcaattctggctgcagaggggtgaagaagctgcacagaaga

SEQ ID NO: 91392 - DNA, 871 bp, Homo sapiens
ctttgagagagtttacaagatgacgatccatctgatcaaaaaaagagaaatgtcctcaacattgttaatcagcagaaaagtaaaaattaaaacctagtgaggtccactacacatccagagaaagtgttatacttaaaaaacgacattaacaaatgttgtcaaggagctctcatatgcagctgatgaaagtataaagtcggtgcaaccactttgaaactatttgtcaatatttaccaataataaacacatgcagatctatgactcacaattctactctcatgtgtatactaacataaatgtaaatttaaactcaacaaagacatgaataagaatgttcatagaagaataaggcaatattgcctcacaccagaaatatcgtaggtatccaatcacagtaaaggtgtaaggtcaaagaactcttgaaactcaacagtaaaagaaaaaaatccaattaggaaacgaacagaaggcatgaatagagacattccaccaaagaggatatacagatggcaaataagcacatgataatatgttcaacatcagtagccactagtgacatgcaaatttaaactacaataagatgtcataacatatctgtcataatggataaaatttgtttatgatatcatcaaatactgacaagaattcagaaaaactggaatcaaacattgctgttgggaatgtaaactgttacagccactcttgaaaatagtaggcaatttcttataaaataaaacatacaaccactgtaaacccagcatttgtgttcttgggcatttatgccatagaataaaagcttatgctcacacaaaaaccaatacataaatattcataacacttacgtgtaataacccaaaactgtaaacaaact

SEQ ID NO: 91393 - DNA, 461 bp, Homo sapiens
agcaaactgccttagcagctctctgatgccagcaaatacgattcttatggaatttaatctagattttctagttgttcttaatgggagtgttagtctcctactccatggtagccagatgcaaaattccatcttttatacttttcaacaagttgtcaacagttggtcacccatctacccatcatccatatcagacatttgctgagcaactcctatgtgttaggtataatgcttagtgttaaggggtgatgagaaaaagagtaaaagtcttctacacttgaagtggtcagtctgatggaagagtcggacagacaaacagatattccgaaggtaggataggtaaaatgctatgagatgtaggagaaggagagtataactttgtagaataagtgagcatttcaaaaagtaggcaatatttaagctacagctcactggataaataggaagttgccacggataaaagg

SEQ ID NO: 91394 - DNA, 186 bp, Homo sapiens
ctggtgctgctgcaggagggggtcgagctgggggtgtgcggacacctccctttgccaatgactcccacacagttgatgagaaatccattgggtcctgcctcgttttgttccccgggactgcagctgttgctccttacttaactccagcattccctcctcatgcagtcccaccctctcccactctac

SEQ ID NO: 91395 - DNA, 271 bp, Homo sapiens
agtgaacacatttgtaagacatttaggggcagcactgatcaatgtgggtagacagggttgagttagggataactcccatatttctggcttggaaaattagggaaataatgggattctttgataagatgtcttatctgtcttatacgttttaacttaaattctgccttctttgcaaaattgcctgtgccatttctttatgaactgaatctgaattttttttttttgagacggagtcttgctttgtcgcccaggctggagcgcagtggcgtga

SEQ ID NO: 91396 - DNA, 315 bp, Homo sapiens
ccaatttccaggaagccatgagtgactaaagcccattaggctcaagagtttgttcacaatcacatacatcaattcagtcaacatttattaacatttattacttattgtgtgtcaggcccacaaattcaaaaaaaagtgcattatctaatagacatataaatagacacacaaaaagccaattatcttgcaataggaaaagtgagagacaggcgttaggaacacataagaaagggtaatgcccctccctggggagagaggataaatggcagatctgggaagcctgcccagaggaggtaacgtttgagctgggtcttg

SEQ ID NO: 91397 - DNA, 1515 bp, Homo sapiens
tagttcctcttttaataccatgaagctttcaagttcatagctcataaaatgttatgtagctttgaattttttaatgtaaatgaaaatcagattcattttcgttattaataaaaatttcaatagtattcacatttagataagagatgcacagaattttggtctacttttaaattaatattacagttcttaaagtaccctaggtgatgcctgttctttgaaacagcagagattttattttaaaaatacgtttttgtgtttattacctaaaggagctattctgaaatttttatgtagaaaaatcttcttctgctccatccacagaagattttttatccatagatatttttgccatctcctttctcctctttcctttgttgtagatgatatgaaaagactgcttttttcaaaaatgtgtttttaaattggtgaattttgccatgcctaaagtgatctctgagatatcctccttttgggtataaacatttctgttaaatgttgtaaagagctttctataatagacacagtagactgtatttaatttttttctcccttcttggtagatctctttggttaaaagaaaatgcgtcacttgcctcctattatagaagcttgtatgagcagccaggggtgcactctgcagggaaggcttggccattgccagtgagccttgctccactgtagctgccttagctcttcctcttttccagatgagcaggtgctgacagccaaaaaaatagaaaataagtggggagaattcaaatatggggaaaatattgtggaaaaaatagatgcttaatttttcttcttaatattatgtagaaagtaaatatctttgggtaaaatacatgaattgtagccactctagaaaacagatgtttaaaatctggcaaataatcttctgctaagttattacaggtccatgatttcatactggccagcatttgtaagttaatccaaatgaaattgtatctccttatttgaatttactgtacatttgataaagacaagagaattaatgtgatgctattgattgtcatatcatcacttctggccttttctgatagcagttcacagcaaaacaatttgtcaaaaaatagtgttttgttttgttttgttttctttacctgagctttgacctgcgtagcaatatgttgatttttaaggtatgttttgtaaattaaaaaaatgctattataaaataatgactttgaagagatggtaatatttctattgaacatattaatggaccactgctatcatgtagtttttaatttagaaggctcaattttagtttttattagaaagaatattgtttagtatcaaatgactattaaaagtatatagtgcaataaaaagaaagacgtgaaggaatgtggaaacattaaaacaaaatcgaacctccttaagtagtagttatatcagatgtaattaaaagatgggatgtaatttgactatcaaatacttgaaccaatgcttttatttgtaatatatatatgtgtatatatgtttttgatt

SEQ ID NO: 91398 - DNA, 424 bp, Homo sapiens
gaagtaaggtcttacccaacgttctgaccccaaaggggcaggactttctcccccactgctggtgtgaaacaggaagtgtcaacccttcaacaaagatacccttggggccacagcaggtgagaaaaggtgccacttcctccaggtggaggcaacccagctgtcagggctggtggcagagtgggatcagggatagacctcagaccccgagcagcatctcagaggccactatggacacagctgcttaagttgacgtggtagtactgccggcgtgtctctatttgttggtatattcacatctctagtatgatttcacacacacagacacccttaaataggcacacacttaagctgggcagagtggggacagaatacaaaatttagagtcctatttactttgcaaataactttttccccagggtatgag

SEQ ID NO: 91399 - DNA, 621 bp, Homo sapiens
ggatcatttctatagtgtgttactagagaagtttctctgaacgtgtagagcaccgaaaaccacgaggaagagaggtagcgttttctcctgagcgtgaagccggctttttggcgttgcttggctgcaactgccgtcagccattgatgatcgttcttctctccgtattggggagtgagagggagagaacgcggtctgagtggtttttccttcttgatggctcaatgacagagactagctcgtaaactccggggcgtttccgggctgttcgctcctgcttggcaatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggagtgcagtggcgcgatctcggctcctagcaacaactgcctcccgggctcaagcgagtctcccgcctaagccctcccgagtagccggggcttaaaggcgcaca

SEQ ID NO: 91400 - DNA, 250 bp, Homo sapiens
ggatcatttctatagtgtgttactagagaagtttctctgaacgtgtagagcaccgaaaaccacgaggaagagaggtagcgttttctcctgagcgtgaagccggctttttggcgttgcttggctgcaactgccgtcagccattgatgatcgttcttctctccgtattggggagtgagagggagagaacgcggtctgagtggaaaagaaaaacgaaagaaaaaagaaacaacggaaaaaaaaaagaatgaaa

SEQ ID NO: 91401 - DNA, 240 bp, Homo sapiens
taaattcgcggccgcgtcgacgtagcgttttctcctgagcgtgaagccggctttttggcgttgcttggctgcaactgccgtcagccattgatgatcgttcttctctccgtattggggagtgagagggagagaacgcggtctgagtggttttcggtgctctacacgttcagagaaacttctctagtaacacactatagaaatgatccctgaaagtatagtcttctggccgcttcgcacacc

SEQ ID NO: 91402 - DNA, 584 bp, Homo sapiens
ttttttttggagatggaatctcactctgtcgcccaggctggagtgcagacagaacaagagacccggagaccccgtctgggggtgggagtggcgggcgggaaacggcgacaaaagagggagcgagaatgggagaaaacgcaaaaagagacaataggaggtgccacacagcatcccccgcctcgcgccaagactaaaattaaaaagccaccccgagaaaacccaagagccgtcaccgctgaaacaggaggcgaaaacctttctcgcgacattgccaagcaggagcgaacagcccggaaacgccccggagtttacgagctagtctctgtcattgagccatcaagaaggaaaaaccactcagaccgcgttctctccctctcactccccaatacggagagaagaacgatcatcaatggctgacggcagttgcagccaagcaacgccagaaagccggcttcacgctcaggagaaaacgctacctctcttcctcgtggttttcggtgctctacacgttcagagaaacttctctagtaacacactatagaaatgatccctgaaagtatagtcttctggccgcttcgcacacc

SEQ ID NO: 91403 - DNA, 568 bp, Homo sapiens
taaattcgcggccgcgtcgacgtagcgttttctcctgagcgtgaagccggctttttggcgttgcttggctgcaactgccgtcagccattgatgatcgttcttctctccgtattggggagtgagagggagagaacgcggtctgagtggtttttccttcttgatggctcaatgacagagactagctcgtaaactccggggcgtttccgggctgttcgctcctgcttggcaatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggagtgcagtggcgcgatctcggctcctagcaacaactgcctcccgggctcaagcgagtctcccgcctaagccctcccgagtagccggggcttaaaggcgcaca

SEQ ID NO: 91404 - DNA, 293 bp, Homo sapiens
ggatcatttctatagtgtgttactagagaagtttctctgaacgtgtagagcaccgaaaaccacgaggaagagaggtagcgttttctcctgagcgtgaagccggctttttggcgttgcttggctgcaactgccgtcagccattgatgatcgttcttctctccgtattggggagtgagagggagagaacgcggtctgagtggttttcggtgctctacacgttcagagaaacttctctagtaacacactatagaaatgatccctgaaagtatagtcttctggccgcttcgcacacc

SEQ ID NO: 91405 - DNA, 359 bp, Homo sapiens
ggatcatttctatagtgtgttactagagaagtttctctgaacgtgtagagcaccgaaaaccacgaggaagagaggtagcgttttctcctgagcgtgaagccggctttttggcgttgcttggctgcaactgccgtcagccattgatgatcgttcttctctccgtattggggagtgagagggagagaacgcggtctgagtggttttcggtgctctacacgttcagagaaacttctctagtaacacttttttttttttttcaccatgcaggggtgacttttatttgaaggcagaaaacaccctatttgggggttcactcataatctgcaacagtttgtttgtttgtttttaaaagtcgacgc

SEQ ID NO: 91406 - DNA, 887 bp, Homo sapiens
tgagatggagtcttgctctgtcacctaggcacgatctcagctcactgcaacctccacctcccaggatcaagcagttctcctgcttcagtctcacaaatagctggggttacaggtgtgcactaccacgtatggctaaattttttccttttagtagagacatggttttgccatgttggccatgctgacaccccgtttctgccaaaaaaaaaaaaaaaaaaagcctggagtggcgtgtgcgcctttaagccccggctactcgggagggcttaggcgggagactcgcttgagcccgggaggcagatgttgctaggagccgagatcgcgccactgcactccagccggggccggcagacagaacaagagacccggagaccccgtctgggggtgggagtggcgggcgggaaacggcgacaaaagagggagcgagaatgggagaaaacgcaaaaagagacaataggaggtgccacacagcatcccccgcctcgcgccaagactaaaattaaaaagccaccccgagaaaacccaagagccgtcaccgctgaaacaggaggcgaaaacctttctcgcgacattgccaagcaggagcgaacagcccggaaacgccccggagtttacgagctagtctctgtcattgagccatcaagaaggaaaaaccactcagaccgcgttctctccctctcactccccaatacggagagaagaacgatcatcaatggctgacggcagttgcagccaagcaacgccagaaagccggcttcacgctcaggagaaaacgctacctctcttcctcgtggttttcggtgctctacacgttcagagaaacttctctagtaacacactatagaaatgatccctgaaagtatagtcttctggccgcttcgcacacc

SEQ ID NO: 91407 - DNA, 217 bp, Homo sapiens
tgtcctatgatgacttcagtacccccaacaaaataggtgtccttgctgtctctcagaacttgcctttcccactgtacagaaagccctttatcatgtcttctctctgttgtcctggagactcctttttaccatctcatgcttcaaaattcagctcctctgtgaatcctttgactttctcttgatgacacacacacaccttctctctgaaattattcat

SEQ ID NO: 91408 - DNA, 414 bp, Homo sapiens
ttcgagactgcactgggcaacatggtgaaaccctatctctattaaaatacaaaaaattagctaggtgtggtggggtgcacctgtagtcccagctactcaggaggctgaggccagagaattgcttgaacccaggaggctgaggttgcagtgacctgagatcgcaacactgcacttcagcttgggttacactgtgagagactgtctcaaaaaaacaaaaacaaaaacaaaacttctatagtaacaattttaaagactttatcaatacctagtctatattatgttattttaaaataatttaagggacattaatcttaagtgatgtatcaactacatatgaatatagctataatcatattacaatgtttatatgatatacaatacctatctgcgtgtgtacatgtatatacatatgtg

SEQ ID NO: 91409 - DNA, 352 bp, Homo sapiens
gggccctaatctgctaggattagtgttcttataagaagaaacacaaagagatttctccctctcttcatgtacacacactgaggaaagcctgtgtgaggacacattgaaaaggcagctacctgcaaggcaggaggagagctcttatcagaaaccaaatcagctggcaccttaatcacaggattctatcctccaggaatgtgagaaaataaatttttcctgttaaagccacccagtctgtggtatgttgttacagaagccccagtaggctaatacactgccttggaatttgcctatgtgatttcccactttccagagcctcctcttccacctctctcctttctctgcttctgta

SEQ ID NO: 91410 - DNA, 460 bp, Homo sapiens
ccctcatcaaggacccactagcctcatgcgtgtcctctgtcatggctctgagcacaccattcatgtatcgagttccctggagactgtgacaccggcacgccagggtcagtggcttttctagacagagtttggaggcggtaggtgctcagagagtgtttactgagagtcagtgaatgcccagaggtagcaaaaaccaccacccaattgtgcttgtttatggtgcacctgctgtgtgcccggctccgcgcaccacacgattccatttgacctcagcaatcctgtgaggcaggtcagtgattatccccattcctcagatgaggagccgaggcccagagaggttagtggctggctcaagggtgcagagctcggctggggcctggggccatctgaccccagcacccgagctcttatcttcatgatctcaccagcatagaatgaggctagtgggatgaggctagtg

SEQ ID NO: 91411 - DNA, 485 bp, Homo sapiens
gatgtgatttatgctatgccaataaggtgcatgtgtgactttaccagaggacacacagggcacccatcttctcagagagcgttgtagggatgacgtggtcctggagcctacccctgtaacagcaatttcctgaatgtgcaggaaaagaaaaaagctcccacgggacccccagttccatggtgtggtgctgggcgtcacctgaccctcagcctctcaagtaccatttaataaacccacacaccagtgagaatgaattctactatctacatactaaggactctgcccaatacagatttaaataggggttttcaaaatgcacctaagacatgtgacttgtatgaacattatttccttagaaaataaaaggtaatcttggcaacttataaaacagtaagaaaataactagccacaaaaccattgccaattataactaattaaggattaatgacaccacacgcaaatttggggtaagaaaaattaacaaa

SEQ ID NO: 91412 - DNA, 1516 bp, Homo sapiens
  misc_feature (51)..(54): n is a, c, g, or t
  misc_feature (172)..(173): n is a, c, g, or t
  misc_feature (279)..(279): n is a, c, g, or t
  misc_feature (282)..(282): n is a, c, g, or t
  misc_feature (286)..(289): n is a, c, g, or t
  misc_feature (291)..(294): n is a, c, g, or t
cgagggatcgcaggatgagcgatcggggcccgggcagccggcagcggacgnnnnccccgagcccaccggcccgcgccccgcgccccccacggccccgcggtcccggtcccggccgcatcacccacgtcccccgagccccacgggccatgcccggccggccctaagcgcgggnnggggggcgtccccttgcgcccgggccccgcgctggcgccccccgggccgccgcccggcgcgggggccatggcgttcaccttcgccgcgttctgctacatgctcacnctngtcnnnncnnnnccctcatcttctttgtcatctggcacatcatagcctttgatgagctgcggaccgacttcaagaaccccatcgaccagggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacaggtgaggccttgcccacagcagtcagaactcagggaagggatgtcccagcatcacgcttccaatcccaagttcctgccttttgcccttgaggactgagggcagcccagggtgtgaccaggtgggcatctgggtggctgtgtgtgtgcagggctaggctcactggctcatcttcctacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaagccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttgtctcttggacctattttctatgtcgcctggaggagtccggcaccccctccccggccatttgtgacaaaatatgaataaactactgcaaataaaaaaaac

SEQ ID NO: 91413 - DNA, 1338 bp, Homo sapiens
  misc_feature (51)..(54): n is a, c, g, or t
  misc_feature (172)..(173): n is a, c, g, or t
  misc_feature (279)..(279): n is a, c, g, or t
  misc_feature (282)..(282): n is a, c, g, or t
  misc_feature (286)..(289): n is a, c, g, or t
  misc_feature (291)..(294): n is a, c, g, or t
cgagggatcgcaggatgagcgatcggggcccgggcagccggcagcggacgnnnnccccgagcccaccggcccgcgccccgcgccccccacggccccgcggtcccggtcccggccgcatcacccacgtcccccgagccccacgggccatgcccggccggccctaagcgcgggnnggggggcgtccccttgcgcccgggccccgcgctggcgccccccgggccgccgcccggcgcgggggccatggcgttcaccttcgccgcgttctgctacatgctcacnctngtcnnnncnnnnccctcatcttctttgtcatctggcacatcatagcctttgatgagctgcggaccgacttcaagaaccccatcgaccagggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaagccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttgtctcttggacctattttctatgtcgcctggaggagtccggcaccccctccccggccatttgtgacaaaatatgaataaactactgcaaataaaaaaaac

SEQ ID NO: 91414 - DNA, 960 bp, Homo sapiens
  misc_feature (51)..(54): n is a, c, g, or t
  misc_feature (172)..(173): n is a, c, g, or t
  misc_feature (279)..(279): n is a, c, g, or t
  misc_feature (282)..(282): n is a, c, g, or t
  misc_feature (286)..(289): n is a, c, g, or t
  misc_feature (291)..(294): n is a, c, g, or t
cgagggatcgcaggatgagcgatcggggcccgggcagccggcagcggacgnnnnccccgagcccaccggcccgcgccccgcgccccccacggccccgcggtcccggtcccggccgcatcacccacgtcccccgagccccacgggccatgcccggccggccctaagcgcgggnnggggggcgtccccttgcgcccgggccccgcgctggcgccccccgggccgccgcccggcgcgggggccatggcgttcaccttcgccgcgttctgctacatgctcacnctngtcnnnncnnnnccctcatcttctttgtcatctggcacatcatagcctttgatgagctgcggaccgacttcaagaaccccatcgaccagggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacaggtgaggccttgcccacagcagtcagaactcagggaagggatgtcccagcatcacgcttccaatcccaagttcctgccttttgcccttgaggactgagggcagcccagggtgtgaccaggtgggcatctgggtggctgtctccatctgccccaacctcagcccaccttgtctcttggacctattttctatgtcgcctggaggagtccggcaccccctccccggccatttgtgacaaaatatgaataaactactgcaaataaaaaaaac

SEQ ID NO: 91415 - DNA, 1090 bp, Homo sapiens
cgcggctgcttcccggccgtgccgacagtgccgcagagatcgctctggcgccccccatggcggcacatgtggagcggtgggagctgctccagtacctgcttctccgccaccccatcgcggccttttccttcccccaacagcgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaagccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttgtctcttggacctattttctatgtcgcctggaggagtccggcaccccctccccggccatttgtgacaaaatatgaataaactactgcaaataaaaaaaac

SEQ ID NO: 91416 - DNA, 893 bp, Homo sapiens
  misc_feature (51)..(54): n is a, c, g, or t
  misc_feature (172)..(173): n is a, c, g, or t
  misc_feature (279)..(279): n is a, c, g, or t
  misc_feature (282)..(282): n is a, c, g, or t
  misc_feature (286)..(289): n is a, c, g, or t
  misc_feature (291)..(294): n is a, c, g, or t
cgagggatcgcaggatgagcgatcggggcccgggcagccggcagcggacgnnnnccccgagcccaccggcccgcgccccgcgccccccacggccccgcggtcccggtcccggccgcatcacccacgtcccccgagccccacgggccatgcccggccggccctaagcgcgggnnggggggcgtccccttgcgcccgggccccgcgctggcgccccccgggccgccgcccggcgcgggggccatggcgttcaccttcgccgcgttctgctacatgctcacnctngtcnnnncnnnnccctcatcttctttgtcatctggcacatcatagcctttgatgagctgcggaccgacttcaagaaccccatcgaccagggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaagggggaagccggccagggagcgagcccagaacggaccggacgcctgtgcacccccagccctcagcccaccttgtctcttggacctattttctatgtcgcctggaggagtccggcaccccctccccggccatttgtgacaaaatatgaataaactactgcaaataaaaaaaac

SEQ ID NO: 91417 - DNA, 241 bp, Homo sapiens
gccttggggagacccaggaggggaagactccaggccccaggtccatctacaggaggacctccagagagacactcacccccttcaggaatgtcccagttggaaggtttcaacccagccattgagttggctcagacaggagtccaccttagaggctggcagaagagtcggggttggcagacagaagacctagaccccagccctgccttccttcagacctcagtttccccatctgtacaatggg

SEQ ID NO: 91418 - DNA, 166 bp, Homo sapiens
  misc_feature (148)..(148): n is a, c, g, or t
  misc_feature (157)..(157): n is a, c, g, or t
caacaaataaagtctgaaatagaggtagtcaatcctttatagaatagttttcagaaaataaagatttactacttttaagaacatctaggagccactgtgcccagccaaaagagaaatttctacatgaacaacggcaacttcagtgtcntacagcggnccaacccag

SEQ ID NO: 91419 - DNA, 425 bp, Homo sapiens
ctttaagtaactttgaagaatgttggcccccagggagtgtcaggaaccattgagagcaagagtgtgattctttgccatttttaatagcagtcagttggcctctgccctttaggagttgtttagattggcaactgtggtgcgttggctcagtgcctaggaagactttggaatcttccactaaaatggagttaaccagactttaaaaggctgagactccatagagctacctggtggtagtggaaataaaaccctgggagctgggctttgtttttcttgatcatccactttacctgtatcagcttctgaacacactgtttgatatattagtttcaggacatctagggaccgcagtgctggactagaaaggaacacttgagcaccactggtcattatcaatggaaaaagattgtatcctgagagaatag

SEQ ID NO: 91420 - DNA, 140 bp, Homo sapiens
taggctcttcatagactcatataactctaaaattaaaatgaaagaaaaatcaaatatcaggattagatgggccttaaaagctatttagatcaacgactgactcaattcctgttttttttttggttttttttttttttttt

SEQ ID NO: 91421 - DNA, 425 bp, Homo sapiens
tgaagaagcattgctttgaaggtttgtagtcctagcataatgtagtaactatatcagggatctgttgcttcttgctattcatgtctttctctttcacatttgaccaaaaaatgagcaatttctcgcattgttggcactgataatgctacggtaggagtgggctctgatattaggaatttggggagcacatgaccattctgaaatggcctatgaaagtggtaggaggactttgggtatcagtgcatatatgcacatcatctgccaggggaaggcaccaaagaagaaatatactgatgaggctgggcacagtggctcatgcctgtaatcccagcactttaggagacgaaggcgggcggatcatttgaggtcaggagtttgagaccagcctgaccaacacggtgaaacgctgtctctactaaaaatac

SEQ ID NO: 91422 - DNA, 553 bp, Homo sapiens
agtaatattaaagaaactatggaagaattatttttgagtcgcagagacaagcctttctaataatgaccaaaaaaatccagaataaaagatcaagttataaataaaaatataaaagatcaaatgtgactttaaaaatggctagagatgagaaaacacaaaccaaatcaaaaagataaaaagataaactgatttaaaaggttttatttcatatcacaaagggtaatttccttaaaagataaagataggacctatagttcagtaaagatacagacaaataaccaaatacacatataaaagcaaagggctcaaacaaatatttcagagagagcaaaatactaaggttcaacaagagaaatgcaaactaataaaacgagatatcacgttcacacagcaggttggtaatgacaaaaagttttgataaaagtcttgcagatggctgggtgcggtggctcacgcctgtaatcccagcactttgggaggccaaggtgggcggatcatgaggtcaggagattgagaccatcctggctaacacagtgaaaccctgtctctactt

SEQ ID NO: 91423 - DNA, 211 bp, Homo sapiens
gggtttcaagccagactggccctctactatacctccaccctctcccaatacatatagccactagacaggagtcctttgtcagataagtggtctttgagcttccgaatatctctaagggagtatgttctcctatcctttgggcccccagctatgcaattttctttatagtagatcttcataagatgaagttgaaaccttcccttgtaattcc

SEQ ID NO: 91424 - DNA, 762 bp, Homo sapiens
ttatacagttttccttggaattttaaagaatgaaataatttctctttatgtcagcaaatgcctattctgaacattcagaatgactgttctgaacagtaatgtttaactcttaaaaaacatggtatttataaatgagaatataataaatcagtattagaagtcattttttaccccatgctctaattcaggagaaaataggagatacttataggttaacttggtgtctgattaccagtgcctgatataatttctccaattccctttttaaaaatctattaaaatatcgttaatttaaaaaatccctttaaaatgaagatatgaaaagctctatgctaaagaatagggaaattttccactaagtcgatcattgattgtattgtggcttttccttaaacccaaagattacccaaagattactgtagaagtgacactacgaaaaatcaaattaatgatagggagagtatacattagatgctcttccagaatgtacagcaaaagaacagagatgaagattgatagatgagagaaaatgatacctatgaaagaaaaaaatagagatttaactggtgactaatagatgtctgcaaaggagacaacagaagtggaacaaaagcatggatcaaatgtctcattgtggaagactttccagggttgaaaatgacctgaagaataaaagagctcactgtattctaaagaacattatgaaaacgtgtctgtacctagacatattttgctggttttcttttgattttaaggatcctg

SEQ ID NO: 91425 - DNA, 456 bp, Homo sapiens
ccccatgtgttatgggagagaccaggtggaggtaattgaatcacggggtggtttctcccgtgctcttcttgtaatactgaatgagttttcatgagatctgatggctttataagtgtttggtagttcctcctgtgttcattctccctcctgctgtcttgttgaagaggtgctttgcttcccctttgccttccaccatgcttgcaagtttcctgaggcctccccagccatgcagaactgtgagtcaattaaacctctttcctttctaaattacccagtctcagacagttctttatagcagtgtaagaatgaactagtaaagtgccctaacacattttggtctttctgtgtttctagaatgttgacttttttcaatcataaggctctttgccctatagtcacaagatagctgctacatgttcagccgtcacatctatattccaggcaagaaaaaataat

SEQ ID NO: 91426 - DNA, 244 bp, Homo sapiens
tgctgccctgcctaacccatgtgcgactctgtccagtaatagcagtggccaatctggggtccaggagtctgcctttgggtggccacagtgctccaccaccccactgcccagacacctgtctgccctggggtctcctgggctcagggccacttgtcctttgtcctggctgtccgctcccaccctcctctgctccctcccatcctgactcagttcccctatcctccttcccacttccctcccccct

SEQ ID NO: 91427 - DNA, 275 bp, Homo sapiens
ggaatttaaaataacaggagatgatttttttaaattggaaaaaacagagtgatgttttactcaaatgctttctaagtacactgatgattatagtatctctttattaagtataatttaataatagatattgatttactttgtaaattatgaagtaagatttgatgctaaatattgttttattattagagttcaggatagcaaaattgagactcaggacaaatttgggcggataatagattttaagatggtctgaactacttaaggattgagataaa

SEQ ID NO: 91428 - DNA, 428 bp, Homo sapiens
aggaggatcacccacactggcaggcgggcatttccactgattcccaaacacacttgccttgttgaattctgactttccaaacagccgcactgggtcttccagagaaggtggcaggctttgctgtgttagcttggggaagccaggcttgagctgtgctcagtcattgtatccatgctccccttcaccataccctcctggcaacgatatgaggtgtggattgtgtgatagaagaatccagactccacgaagccaaggacagtcacttctccctggcagctctcatggtgtcggcaggagtgggcgcctcaccttgggtactgaagagagtaccgataatcccgtggatggaacaggagggagtgtaattcaatccctacacattgtatatgctgttggcaatttcatttaaactcacagcagaaaacaac

SEQ ID NO: 91429 - DNA, 927 bp, Homo sapiens
agaaggcagcaggggaaggaaaaggagcaggggataggggaactttaggagcagagtagtgttgataactggcatctggaacctacagtttccagttcagagcagtacaccatactcagtgtatacttacactccaagacatttcctgggcagtgatctagaaatgatatttttaaaaggagctgtgtttcagtgttagactgtagttatccaagcagtatcagatagtgtgcagtttttgtagtaaaaggtaaaaatctgaataataaagtttattaataacagttttagttaatacttgactgacattgagacccttgatgcaaaaaggtaagtagaagagaaggctgtaaacacaagaccatcataccctgtggggaatttacaatctaaatataacaaacatatagagtgagataggagaaaagaaatgggatgataatgatattgctgtactaaagtctatttaggaaatggaaatatatagcaagaggagtcagctacttgggcattgatcaaagaaaaataaacatatagaaggaaagaaaggtcgttttagtttataacattttccttccgattctaggtgattatatagctagtttactcttccacccccaagattctggggtattttggctaatgttatttgcaatgtccataaactcagaagaagttagtattaacggggatatgaaagaacctccagttactatgcaagaaattttaaatttccatcatgttaaattgtacaactgtttatcattcactctgctgtaagtctatgtgaaaccaaatccgtggatttaccaatggccattttatcacctccaaactatcttttatttttttgaattgtatctctctccttattccattttcttctgtttgattaaaatcctgcatgttctcctgcatcatatgtca

SEQ ID NO: 91430 - DNA, 1732 bp, Homo sapiens
  misc_feature (1511)..(1511): n is a, c, g, or t
taaattatttgaaagcataacttcacaatttgaaggcttgaatcttatgcctgctagtcatgaagttaaaaacatagctttgaaaaattaaagtaagtgctggaaatttgaagagaagttactggctcgtagtagattttacagatccctcttggaaatcaggtaaaaaatgggaggtataggtaatcagaatgtcataattaagcttgatttaatagataacgcaagattatatgtaataaacagaggatatatgttcttttcaaatacccgtctattttaaaattggttatgagaccacacatacatacacacacgtgctaaaaaccaaaaacatgcaaaactcaagaagttaacaaaagtagggaattgtacagcctacattccattctctggcaaccaggcagtaagactataaattaaaaaagaaagctccccaaaatgtagctatgcagaaatttaatatcactcttctaaaaagtctttaaaaaggaaacatataaattacttagcaacaagtcacactgaaagcaatacattatcaaaaatcagaatataaccaaagcaatatttgattgaaatattcaaagcataattaaaattgtttgtataataactctttaagaaatgtgtttgttataagacaaccaaatagaaatgaaccaagcattaatcttaaaacactagaggaggctgggcacggtggcgcacgcctgtcatcccagcactttgggaggccgaggcgggcagatcacgaggtcaggagatcgagaccatcctggctaacacggtgaaaccgtatctgtactaaaaatacaaaaaattagccgggcgaggtggtgggcgcctgtagtcccagctactccggaggctgaggcaggagaatggcgtgaaccggggaggcagagcttgcagtgaaccaagattgcaccactgtactccagcctgggtgacagagcgagactccatctcaaaaaaaaaaagagttagtgtaactttgaaactaaaattggataaggccaacataaaagagagagaactaaagatgaacattactcaagtttataaatttaaaaatcttaaaatgttaggaagtcaaattcaacaggatctttaaaaacagtttattcttagaacacaaggatgatttaaaatccaaccgattatattaataaattaaagagaaagccagtgtgattgatcatcttgaaaagttgaaaagcatttaataagatttaacctgcatttttaacattcttacatcccttctagccgtcaaactctgatcgacttacacttaagactgtgtctttggtagcctaccctattccacttttattacaaaggcagctcttaagacataaatccatctcttcaggctcgaactgcaaaacacacgtcgagaggtgacaatgttgggactgtcaaaaagaacttaaagagtgggataaccagccgggcgcggtggctcactcctgtaatcccagcactttgggaggctgaggcgggtngatcacaacatcagaagatcgagaccagcccggccaacatggtgaaaccccatctctactaaaaatacaaaaattagctggatgtggtggcacgcacccgtagtcccagctactcaggaggctgggacagaaaaattgcttgaacccaggaggtggaggttgcagtgagctgagattgtgccactgtactccagcctggcaacagagcaagactccatctc

SEQ ID NO: 91431 - DNA, 270 bp, Homo sapiens
ggtatgagtatgtgactgtgtatgaagtctgatgaagctttcgatgaacttggttaggtttcttggatgagcagttcaaactagctcatcccagggtagtagacaacactgtgatgtgcatgggaagtctcacatccaacccacacccaataactatgtggggtataaaggccttgccatgtgaaaggttattctagctccagggcttccagtgggttggctgagtctgttgtttgactcctcactcttccgactcctgcctcctttctc

SEQ ID NO: 91432 - DNA, 436 bp, Homo sapiens
tctattgatacttttatgtttaccactgtattactaaatataataatttatattaaaggcagtggctgttgaactattttaatgttgtcattttacttgtgagataaactttatactttatcccacttagttagcacctaccagaagacaccaaaatggtttatttcaaaattactttttaaaaattattacttatgagtttttcttttatggaatttttgaaagatgatcagagctttccagtctttttagcagagatttgcccccagggcaaattgttttaccagcatctaaccaatatgggttttatcagagtttaaccaaagtaggagaatggaaatacccaatttagacccctcctgctttcttgtctcacctaaggaggggttgacctgagaagcaccgaagatcgcagccaagaggcacagaccactaa

SEQ ID NO: 91433 - DNA, 578 bp, Homo sapiens
tcagcctcccaagtagctgggactacaggtgcacactaccacgcctggctaatttttgtatgcttagtagagacggggtttcgccatattggccaggctggtctcaaagtcgtgacctcaggtgatccacccgcttcaccctcccaaagtgctgggattagaggcatgagctactgcgcccggcctttccctgcttcttttaaatggaatattttagtgttccattttatctccgcttttagcctggtagcgctacctctttattgctctagagtttccattctctgtctttgactaggactttggctttgaatctgagtgagatgggagccatgggagggctttgagctggggagtgacccgacctgacattcctgtcttcttatgtcaataagaaaaataaaacaaaatagtagtaaagtgtcggggtggcgaaaatttttgggggtgatatggagagataatgggcgatgtttctcagggctgcttcgagtgggattaggggcggcttgggaacctacagtgggagagattcaactgaagaaagattctgcggtaagggctgatactgtggggtt

SEQ ID NO: 91434 - DNA, 870 bp, Homo sapiens
ccccatgcccagctaatttttgtgtttttagtagagatggagtttcaccatactggccaggctggtctcgaactccagacctcgtgatctgcccgccttggcctcccaaagtgctgcgtgagccaccgcacccagccgacaaacctttattaccaggtgatatcaaatattattagagctgactgtggtagtgacagtttttcatataaatgaaattgcatcctcccaaaggaatcctgagtatgtatgcactttaaaagaacccagaatcatctaaatattgtcacatggctcttgcaagtgatgataatagtgatgcttataataatgaggattagctgcactcatcagcctgtagaaagtaaaaagtttccttttcgaaatttcctttcttgttaaagaataaatcataagtgttagaaataatagtttcttttaaagactaacttccttcaagcctcctctgctctgtgctaatgactcttcattaagccctatcctatgtagctgttagatataagggaataagtatattctatgtccttgtactttaaccaagatatttgtgctggacatgctcacaggcacgttccagcttgcagcctatgccccttccttatttggaaatattattacttttctaagtctttttgcaagcaacttcttcttttcctttgttctctattgcctttccctatataggaaagttttaagttattagccagtcgggtttaatttaaattgtgaggtccagctccagccaatggagacaggacacaagctgcataagggataaaaactgcttccctcctttgttcgggtgtgctgtcaccattgtttcatctgtgaggagcaccctttctgcagaaa

SEQ ID NO: 91435 - DNA, 901 bp, Homo sapiens
cagtaactgggaagaaaacagtagtccaaagtagaggggccaaactttgaggaggaggctttggagtctggaagtgaggaaagagtgggaagggcattttatgctctgacagctacaagagcagagtcagagatatttgtaactcccagttaggagatttgaataacagaagtactcttgataccaggtgatatcaaatattattagagctgactgtggtagtgacagtttttcatataaatgaaattgcatcctcccaaaggaatcctgagtatgtatgcactttaaaagaacccagaatcatctaaatattgtcacatggctcttgcaagtgatgataatagtgatgcttataataatgaggattagctgcactcatcagcctgtagaaagtaaaaagtttccttttcgaaatttcctttcttgttaaagaataaatcataagtgttagaaataatagtttcttttaaagactaacttccttcaagcctcctctgctctgtgctaatgactcttcattaagccctatcctatgtagctgttagatataagggaataagtatattctatgtccttgtactttaaccaagatatttgtgctggacatgctcacaggcacgttccagcttgcagcctatgccccttccttatttggaaatattattacttttctaagtctttttgcaagcaacttcttcttttcctttgttctctattgcctttccctatataggaaagttttaagttattagccagtcgggtttaatttaaattgtgaggtccagctccagccaatggagacaggacacaagctgcataagggataaaaactgcttccctcctttgttcgggtgtgctgtcaccattgtttcatctgtgaggagcaccctttctgcagaaa

SEQ ID NO: 91436 - DNA, 423 bp, Homo sapiens
ccacctcacctttctctgcctcatcatgtcagaaaaagtacccctccttttgtcacaaggcaaacctgagataaaagatttagatggcctgtaattccagcactaagggaggccaatgcatgcagattatttgagtctaaaaaagaagcctaagcaacttagggaaactgcatctctcaaacaaatacaaaccattagcctagcatggtggtgtggtggcacatgcctatagtcccagctactcagggtggggagcactgaggtgggaggatcacctaagctggaaggttgtggctgcagtgagccgtgatcacgtcactgcactccagccagggtaacagatatttttaaaaggatcttctctgttaaaaataatcaaataaacaggtggccatgaggctagtggctgcagtgcactcaatt

SEQ ID NO: 91437 - DNA, 298 bp, Homo sapiens
aagaccgcgggtgcacctctctgggaaaggaaccccttaggtacaggcagtcatttttaattttcttagaataatagaactgaaagaactctttgccccttcccacagaagattttactttatttcctgattctagctccccttggtgaggaaaaaccataagagagcctggacaacttccatgtagtactgacattcactcttttttatcaattgttacaaaagactgcaaattccctgtggtagctttttgtaaataaatgagatactgtttataaatcttaccaattagtaaatg

SEQ ID NO: 91438 - DNA, 543 bp, Homo sapiens
tagtagaaatggggtttcaccatgttggccaggctggtctcaaactcctgacctcaagtgatctgcccgtcttggcctcctaaagtgctgggattataggcgtgagtcaccacaacctcaagtgatctgcccgcctcggcctcctaaagtgctgggattacaggcgtgagccactgcacctggccagcaaaatgaagttttaaaaaatgatccaactatatgcttttactagagactaacttaagatccaaagatgcaaataggttgaaaatcaaagaatagaaaaatatattctgggactgggcacagtggctcatacctgtaatctcagcactttgtcttttgttttttttgagacagagtctcgctctgttgcccaggctggagtgaagtggctcactgcaacctctgtctctggggttcgagtcattctcctgccccagcctcccgagtagctgggactgcaggtgggtaccaccacaccccagctaatttttttgtattttaagtagagatggggtttcaccatgttggccaggctag

SEQ ID NO: 91439 - DNA, 810 bp, Homo sapiens
acgcagggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaagaaaagtcttagaattcatttgggt

SEQ ID NO: 91440 - DNA, 855 bp, Homo sapiens
accgtatgaggacacagcaagaaggtgccatctaggaagcaggaagcagggcctgaccagacaccaaatctgctggggccttagtcttgaatttccagcctccataactgtgcaaaatccatttctgttgcttataagctacccagcttatgggattttgtttagcagcccaaatggactaagacactcaatgttagaagacttctttctccttcctgctggagaaattcaactgcattgcatggagagctaattatatggagagacagtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgtt

SEQ ID NO: 91441 - DNA, 780 bp, Homo sapiens
acgcagggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgtt

SEQ ID NO: 91442 - DNA, 803 bp, Homo sapiens
accgtatgaggacacagcaagaaggtgccatctaggaagcaggaagcagggcctgaccagacaccaaatctgctggggccttagtcttgaatttccagcctccataactgtgcaaaatccatttctgttgcttataagctacccagcttatgggattttgtttagcagcccaaatggactaagacagtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaagaaaagtcttagaattcatttgggt

SEQ ID NO: 91443 - DNA, 215 bp, Homo sapiens
acgattcagttaataaagggatggttccagttgagggccaaatgagtgccctagaaaatcaaatgcaattggtattacaaagcccagggaaaaaaccaaacaacatattatttttaaaaagtgataaatcgtgaagcaaagatgagagatttttatgagtaattatgtggcacaagtataaaaactcagcaatttatgtggaaaaataaacagcc

SEQ ID NO: 91444 - DNA, 630 bp, Homo sapiens
agtgcaatggcacagtctcagctcactgcaacccccacttcccaggttcaagcaattctcctgcctcagcctcccaagtagctgggactacagatgtgcgccacgacacacagctaatttttatatttttagtagagacaggatttcatcatgttggctaggctactctcaaactcctgacctcaaatgatcgactcaccttgctttcccaaagtgctgaaattacaggtatgagccactgcatctggcctcttccttctttctttccttcctgtcttcctttagttaaaatgattttctctggggatgtgatttagtttcttgctttttattttttgtgtattcattgcatgttttttggtttgaggttattatgaggtttgtagatactcttacaacccattattttgcctgataacaacttaacactgtctgtgtaaacaaataaacagcaaaaagaaaactgataaaaactctgttttaacttcatcccccccgcctactttttcactttctatttttttgtgtacttgctattaccagtgagttttgtaccttcaaattatttcttattgctcattaacatcctttcctttctgactgaagttctccctttagcttttcttatag

SEQ ID NO: 91445 - DNA, 299 bp, Homo sapiens
gactagagatcccatccgggtctggtattggataaggcgtgtgccaccacgtctggctaatttttctgtattattagtagagacggctggtctctactaatagttcaagacggctggtcttgaactcctgacctcaaatgatccacctgcctcagcccccccaaagtgctgggattacaggcgtgagcccctgcacccagcccctctggttctactgagacctcagatctttcatttatggaacaagggggttggattagattgttcgctctcagccctcacttcatgttagactcact

SEQ ID NO: 91446 - DNA, 294 bp, Homo sapiens
aatgccactgcagttagcccgtatagatcacttcatgaaagtggtttcaataaaatgctgaaggcagaacactgagtctagcagtttacgaaaagcaaagagtgagtggtgagaaagtagaagttgggattattggttttttccttccaagagatttggaagataagatcgcagaaggtcacatccaagaatggttttaatatttcaaacacagagcactttcctggggttcatgtataacctttttaagatttgcctggggaaaaacagtacatctaagaactgaggcttagg

SEQ ID NO: 91447 - DNA, 197 bp, Homo sapiens
tacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcg

SEQ ID NO: 91448 - DNA, 945 bp, Homo sapiens
agacatcaaagtccacttctgagagagaaatagagtggctgatgtttacaaaacagataagtagccagaaaagcaggcgataaggaggagtttcccaagattagaaagagactttttaaagtaaagggtaacggtgcaggagagtgttttggttccaaaatagtgaggactctgctcttttaacaccagctgcaccaggaaggcagcaattacctttacggaatgcaatatgtatgtcaagggagaatgaaattcaaatggaatttcatatgaaatatgatgtgtccagggaaatcagcccagaagcctgaaagtacctagccacacccacgatgctcaattccatgcatgactctggagcagcagaaagctgctgggacaatgggggtactagtgcaatatgccccctcagcaataacccctgaggacacgtgagagattactgaaaaggccccaggattgtggcatgactgaagtgagaggggagccctcaagtctaagaatactgaatttcccagcagtccatcagagtaattcagagtcaaaaataatgttgacacacagaaataaatgaaggccatatttcttggataactggcatttagaatgagacacgtgtcctctagttatcattattactatttgcactagcatttgtgctaggctctgaatacacaacagtgagcaagacatacagccgttgccccctgggagtctatagtttaataaagaaaacagacatttgaaaagcaatatgagtaagtggtgataagtatcacgatgcaggggatatgagacaaaaatgaatttaaggaaacagaaccaagctgaggggccagagaagacctcttagagggagtgaggagaaagctgagaccagaggtatgacactgagacagaggcaggtagggaaggacacaggggaggggttccaggctgggtgag

SEQ ID NO: 91449 - DNA, 335 bp, Homo sapiens
agtgcaaaatttccttccttctccatgcctgtggaagaaggaaacctatttcctaaaacttgatgatccctaggaggccctaaatgcacacctgggaagctgttcaccaggctctagataaaattcgttccatccaacagttccagaccactgcaataaagcaagtcatgaattttctggtgcatatacaagttatgtttatgtgatactgtactaagtgtacaatagcattatgtctaaaaaacaatgtacattaaggaatgctttattgcttaaaacatgctaacaatcagctgtgagtcataatctttgctggtgtatggtttgcctcaata

SEQ ID NO: 91450 - DNA, 361 bp, Homo sapiens
gattacaggcgcctgccaccacgctcagctaatttttgtagagacagcgtttcaccatgttggccaggctggtctcgaactcctgacctcaagtgatctacccgcctgggcctcccaaagtgctgggattacaggtgtgacccactgtgccaagcctgacccttgtccttgtcagtacctgtgactgcattgttttcatattctcagtttcaggcatcctgttctctagccagtacctcctatttttctagctcacgcctactagtactccaactccagcaatccctcaatcccactgggactgaacattttcactccctttcacttcccccatgctcctatgtccctcctttaatcagct

SEQ ID NO: 91451 - DNA, 511 bp, Homo sapiens
gaagacacctgtgagctaaacagattgctccctccccttcttgagtttagagcctctccactcattctcttgatttccctaaaatatcaggagaacacgttgaaaacaaatcacaaaaaaattggtatctcttcctgttctatcttctgtcattcctttccatcagttaacaactgaggctttggaatcaggctcaggttcttcattagtaaattgcagataataactacacaagactgttaatatgataagtaagataatgcgtgtaaacagtgcagtacctgtgaaaatattaagcattcagtatctgataggtattattaaactgtgctcatttttatcattacagtttcctccttgtacttatcttaaattgtatatggatttgtgggcatggttaagaacagggaaccctttctggtaccttacccatttctcttctatccccttccccctaaacacacatacacaatttgtggtacaatttcaagacactagcttggcaatgctc

SEQ ID NO: 91452 - DNA, 141 bp, Homo sapiens
gatttggcttgagtccctgggtagatggcaatggtttttattgggatgggggtggctgggaataggttgagggtaagagtggggaagtcaagagtcagtttggacctggttaagtttgagatgtcttttagtcatctaagt

SEQ ID NO: 91453 - DNA, 258 bp, Homo sapiens
agatggccattccctgaggcccagggtctcagcaagctagaaagaggaaagcaatctgattaaaggaacctacattaaactctgttgatggcagccctccaacctgcccgttagtgctgttcatgtgaagaagcagggaaaaaatccttttagtccattgaatcacatgttaaattagttctagaaacttggagaatgagagggagaagtatgtgaggtcttcttcctaccacttgcttgaacttaactccaagcacc

SEQ ID NO: 91454 - DNA, 295 bp, Homo sapiens
tctgcctctaacttctctgctgtgagactttgagaaaatcgctttatatcttttaaacctagttttcttatttggaaaattagaaggatgagctattttattgctttgtaaactagtcttgtgagatgcctacatgagagtaacctagagaagatgtatgaaatacaaatttctgggttcacctcttgaaattcgtattcaataattttgggatgagatctggaaaccaacagtttaaaaagttccttatatctgtcaataggggatgatgagttaaagacgtaaatatatactt

SEQ ID NO: 91455 - DNA, 512 bp, Homo sapiens
gtgggaggtgcttgggggattagaagcaaagctaaatgcctctaccttggagcaaattggagaggtagagtaatactttttttcattcatattcagcatttagcacactttattgaacacttataatgagctgggcatttaggggaaataaagatgcaggaaggcattgccccattcctgcgcctactctttatgaaagggcgccctataggagtctctcttcattctcatcacggcctctgtctgtcttctgggcctcaaccctgttttggcctactggatttgctaaccacgctggggccctgttgtcagtcatttcagcattgcttttcctatgaccttagtagcccttgtctgcttgatctcacgccgtttgaattttgctagctgccaccttcaaccacttccctctgttttttattttcacttttactcctaggttcctgaaagtactaaattgaccttaagaatgaatgcttgttttaaacgatggtgaggctggattctaggtg

SEQ ID NO: 91456 - DNA, 525 bp, Homo sapiens
tctaccttgaaactgcatcaagaaatcagtatagagggaagctgagcatgcccagctgttaatatattctccctaatattccactaagccactcactgtgtcctcatttcttttacatagactatggattgtgtgggttgatataaatgctaacaatcaaataattaggctttttctttcatgttgataactccagatttacgtatttgggcagtatattaaagctaggaaagtttttaaatgttaagtcttgtccatttataacatggttcagaaataatgaattgagagtttctgatatgaaataatcagtcaaatttgctaatgtgtctataaaaatatggttaaaatgagtataatgattttagatacaggggaacatttctgtgatactgtcctgataattaaaatcctaacattacttaacagctttatgatgtgacagcagatgcctagagtaggtagttttattattttgcctcgtacctttagcctatgtgaatgtatgtggtgatcaattaaatt

SEQ ID NO: 91457 - DNA, 627 bp, Homo sapiens
gtgttagataaaggaactttgtaaatgttttatcttaaaagtttacccagagttggctgggattacaggtgtgagccaccgtgcctggctattttctttcttactctaggtttctaaaatcatgcatttgttttatgacaatgctttcctgttattcctgtgtccagacatttggcttttgaaattgctatttctctctcattaagagactttactgccttatataaagatggagggcttaagattttagattgaatttctgctttgctgtaattttctaccttgtttatgtttttaagttttttctttttttaacatttaacattattggtaatagaatgtacaggtgtgtgccagtagtctcagctgtttgggaggctgaggtggagaggtcaagattaggtggagagatccctttgcccaggagttgtgggttgtagtgcactatgctgcttggatgtccacactaagtttggcatgaatatggtgacctctcaggatgccagatagcttaaggagaggtgaaccagaacaggtcagaaacagcaagtcacaacccccatgctggtctgtttgtgggatcatgctagtgaattaccactgcacctcgtctcttcaaaaaaaaaa

SEQ ID NO: 91458 - DNA, 251 bp, Homo sapiens
ccagaatgaaagcattttattattttataactgtcagatcaccagccttctctatttgaatctaaatgtatgcatgtaggtgtgtatgcatgtgatctctacaccccttgactcctgaaacagatgtcatattatttttattattgtcatattatttgcatcatctcttctttttccttttccatccccaatagaggtcattattaaaaccaaataaatgaaccaatactaataaagttaacacgtacttc

SEQ ID NO: 91459 - DNA, 133 bp, Homo sapiens
tctccagggacaagtgatctgtggtaacaatagtctttctaccttcagagttccctcccatcagaaagcaattacacatccttttgagtgtgtttaaattggaagaaactttgctcccctggccctattttcg

SEQ ID NO: 91460 - DNA, 383 bp, Homo sapiens
aggaattgtgggagttaaaaatctaagatgagatttgggtggggacacagccaaactgtatcagccctcttctagtttgcagacagccaacttctctttgtatccttacatagtggaaagagaggtagctagcttttgggcttcttataagggcactaatctcattcatgagggctctacccttaggacccagttacctcctacaggccccacctctaaataacatcacattgggattagagtttcaatatatacatttttaaaggacacacatattaagtccattgcagcaaatttttttttacagttttttctttctttctttgtttttttttggagacagtctccctctgtcgtccaggctagagtgcagtggtgagatc

SEQ ID NO: 91461 - DNA, 388 bp, Homo sapiens
gaaaaaaaaagacaaccagtttagccagtaagttatgtagctttcatatcaaagtaagattcagcaatgacatacgtatttcttatattttttgagtgcagcattctaggcagtgtggttattaaaataggttcagtaatgacacatctgtatttattaatacatttttttggtgtgttattttgtagatactgtgccagtatacagaaatcagtaagacttgatccctcccattttgtagtttagtagggatacaggcttgcaagtaaatacatacaatagtgtagtgcagggtttcccaaccgtggtagtattgacattttgggtaggataattcattgttggggggatctgtgctatgcattatagcatattttgcagcatcact

SEQ ID NO: 91462 - DNA, 288 bp, Homo sapiens
gagaaaaaaaaaaaaaaaaaaaaatgcaactatgatttgctagaggtattccctctaatttctataagagggtctggaacttgctctgcttttagcacagatctttgagctggtgacatcatcaatgctgcttcctccacattcatttcttaactctcctaacttttaagtcatcttagcttcttatctccctagactaaggagcaaacttaacttactttctggccttattgatatgaatgtggttggtatttgagcatctatcatgcagtcattctggaagatacc

SEQ ID NO: 91463 - DNA, 412 bp, Homo sapiens
ggctaattttttgtacttttaatagagacgggggtttcaccatgttggccaggctggtctcgaactcctgacctcgtgatcctcccgcctcggcctcccaaagtgctgggatgacaggcgtgagccaccgtacccagcctcggtgaaaacctcagaggcaggcagcatattccctgccgagccggtaggtggcgcagtcagataagcattaactaaatcacagctccctctccccatcagaatctttatctagagggtaaccccaaacctgagaatttggtcaggtccgcacacacacaggcatcatcattcttcagcgccatcatgaagggctcttctccccctgttaaaggaaactatcacatagtcttccgaaacagccagtcaaaaactttgtgatgcaggaaagaac

SEQ ID NO: 91464 - DNA, 283 bp, Homo sapiens
tctcagtcaagtttcagtagaaaaccaggcgtgagggtcccaatgagaattcagaaacataactcactttcaattttcacttgactttgctattctcatcttgccacaggcaattagtctctctccagaaccctgagggcaaatctgtccttcctgacattaggatggtgggagggagctacagagtgtacccctccacacattcacccgtggggcttgacatcaggagagtacatccagtatgttcagagaagggcgtccagttctgctccccatcattctt

SEQ ID NO: 91465 - DNA, 2697 bp, Homo sapiens
acggctttctttgaggccaggactgggtgatggtgtcgctacccccgccgcagtctgacgtcacgctgccgggccccaccagactggagggcgagcgccaaggggacctcatgcaggcaccgggcctcccaggctcccctgccccacagagtaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctgggttcagaggtcaaagtcaagcccccagttctggagagtggtgctgggatgttctgctaccagcctcccttgcagcatatgtactgctcctcccagccccccttccaccagtactcgccaggtggtggcagctaccccataccctacctgggctcctcacactatcagtaccagcgaatggcaccccaggccagcaccgatgggcaccagcctctcttcccaaaacccatctattcctacagcatcctcatcttcatggtccttaagaacagtaaaactgggagccttcccgtcagcgagatctacaattttatgacggagcactttccttacttcaagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggcatgagctgtgcccagcttcgtcagctccagcgtttgcctggtctggaagtcctggccggccgcccacatcgggctcaccttaaaggtcaaggaaggaaaatactacctgtcccctatgccactaagccaacgtgtgtgtcagctggtagctgggggcgcagaggacatcacctggggtgctgcctctcacacatttctgccacgtggtggggcagctcctcacccagggcccccaaagagcaagcgtctgggcaagaggaaaatgccctgtccctagctcacactcatccacacttaagccctcgtgcacacacacaaattattcagatgtacacccacccacatatcttacagccagaggaaccagcactccatcactgagagcccgacttcgtttctggggcaactgagagctgagcgctttgcttaccaaaagctcagggccctgtgccaggccaaagatccccccagacccccattctgacatccacatgctctgcagtcctggccccctcgtcattttctttcccagaagcgccctgtatttattcccccatcttcatcccaacagcccagcaagaaggaggagacagagagctcctccctgggttgtctgtggacccccccaggagctgctaattggcagcacccactcagccattctctacccatccttagtacatgctctgtccagctttccccagggtgacatacagaaggggcaa

SEQ ID NO: 91466 - DNA, 416 bp, Homo sapiens
gatgtggttgtttaacaaatagatgggagtgtgtttcttcgatggcttcttgtccgtggcagttctggggtcccccccaccgccatttttttgctcccttgtctgcttccataagactaatcagtctgcaggaaacagaaagcaggctgtagtgcctcgtcccccaggagtcctcaccccatgggcagattagagggaagcagcagacagagccccgccccgggctcccgtcggctcctggccatcctgggcttatgtggcctttgtctccaccctcacagcctccagatggcttctgtgcctcccagcaggaaggaagacaaggacagagtgcaaagggcagaggccagctgccttgaccttatgaagctcaccctggcatgtgttcccagggccttgcccagttcactctccct

SEQ ID NO: 91467 - DNA, 369 bp, Homo sapiens
caatctttccttttgttatgttgtcatggtaacaatagggctcaggctaaagcagcccttatagttcagtgtaaatcatatttaacatttgagaagtttccccttttgactcatgctttgactgagacgttgaaagatccgcatggtgtgctgagacaatatggtcaataacgatcttgatcctaaaatctagatatactaaaatttaaaaggtgtttgtctaggagtggatggcttgccgggtttttgtatctcttcctcttcaccctgaccttcctatgaatacagaaaatattctacacttctttttttttttttgagacagagtcttgctctgtcgcccaggccggagtgcagtggcacgatctc

SEQ ID NO: 91468 - DNA, 295 bp, Homo sapiens
cactgcactccagcctgggtgacagaacaagaccctgtctcaaaaacaacaaaaaaagaatttggggctcctgcctcatataactagttagtggcaaagttgagatagactctgaaatcctgggattgactctacaagaatctatatttgtgttttttactatatcctactgtctaatttacggtctttaagcactaaactcctttttaacctgttaatcttgcctatcaagttgcattttgagaaaaatgaaccatgtatttgtgtttctccataactcctaatactcacatct

SEQ ID NO: 91469 - DNA, 415 bp, Homo sapiens
actgtgccaggcaagagatcatgacaaagctgttgagaccagcagagcatttctctctgctggtccctgatctggggcccctcagctgccctgcacaacgaaggatgggggcagtggggggaattcctgagactttcttgggcttggctaaagtcctagaggctccaggaggcagggggctcctatacacttccaccaacctgtgaagaactgcagcagaaaactgcactgtgggggagaagggaagggtggcgaggaaagtatgaaagatgtgaggaaaggtgcgagggcttttggggaaacagtgtagagggaggggtcttcatacctagaacatcactttatatgatgttttcaaataatccttcaaaaataatcaaataatcctttcaaataaacctttatctgatgtttt

SEQ ID NO: 91470 - DNA, 300 bp, Homo sapiens
ctaatatctttttaggactaattatgtgtcaggcactatatattaagtgccttaacctcaaactctcttaatattctcaacaacctaatgaagtaggtcctattattaaactcattccacagacaagaaaactgaggcacagggagaggaagtaacttgcccaagatcacactgctagcaagtaaggggactttgttccagagtctgtgtgccactgtacccaactctcttacctttccacttgtaccttaatcactgagtaccaaacctcctggtgaaacttcagggcttcaaagtccc

SEQ ID NO: 91471 - DNA, 202 bp, Homo sapiens
ggaaggatgtatcatcatctctttaacaggtgaagaaaccaaggctcagagagttaagctgctaacgctcctgatttagctagtgggtagctgagctaacatctcagttctgtcaacatccagcccaggttctccactaaactgcctgtgatgggagcacgggcccagcttagacagccttctatgcctactgaaccctgcc

SEQ ID NO: 91472 - DNA, 223 bp, Homo sapiens
cttgtgtttaatatggggctgatttgctacaggggtttttcaatgtctgctccactctcagatttaggtttgagaaagaaataaaagggcagttcctaatattcggaaactggcctgacactcacaggtagacgatattattctcttgttagatatccacgatatcacagaatgccacctcggataagtttattctgagaccaagataaaaatgagacaaaga

SEQ ID NO: 91473 - DNA, 415 bp, Homo sapiens
ccatgtgaaacaacagtcctctctctagcaggactgggtttctttccatgcagaggttttgtgctgtgaggtttgttgttaatggtgtctgtacggttcctttgtctttcttgtacataatgaaaattgacctaaggtaacacatcttttctttgtctctgttactaagtcatgaataaattagtcttgctttctactctgaggcccagatcaatattctactggaatgttgattgttttagtgaatggaaatgaactggcagaatgccattcagaatacttgagcacaggctaatgaaacatttgcatgggtggatgaaaaggccccctgatagaaattaagagtaacatttgcatagtttcctgctatttacaagcacttgcacatatgtttaattctcacaaccactccatg

SEQ ID NO: 91474 - DNA, 889 bp, Homo sapiens
ccctgaaagtcatgcgggatgaaccctcagctgtaatatcctccttgactgcaggactggcagtcgtgtggctctagaggaacctgtggcaggacaggttaagtaaggcacataggggagggggtagcttctgatgtgcttctttgctttctagtacatttctctcattttgtgtgttttattgtgaactaaaatataaacttagacttgaaaatgtgacaagtaaaaatggttgattagtcttggatgctaattgtcaattaatattcattgcatttgtttatagtagcctccaccctcccatccacggttttacttttcaaggtttcagttaaccatggtccaccgaggtctcaaaataagtgagtaaagtacaataagatattttaagagagagagagaccacattcatataacttttattactgtatattgttatcattgttcacttttattattagttattattaatcacttactatgcctaatttacacattaaactttatcataggtgtgtgtgtataggaaaaaatatagtgtgctctgtgctatgttagttagttctatgatagctcagtactatctgtggttttaggtatccactgggacttggaatatatcccccatggatgaggggaaactactgtaccgtgttggggattttttatttatttattttttttttgtgacagagttttgctcttgtcatgcaggctggagtgcaatggggtgattctcctgtctcagcctcctaagtagctgggattacaggtgcccaccaccatgcccagctaatttttgtatgtttagtagagacggggtttcaccatgttggccaggctggtctcaaactcctgacctcaggtgatccacctgcctcgacctccc

SEQ ID NO: 91475 - DNA, 312 bp, Homo sapiens
ccaaaatccaaaaacaaagaatgtgcccttatttggatgcataaagcttctttgaagtttaaactcttctaaacgttctttatagaggggactgtttctttcttttttttttttttttagataataatacatgcatttattttttatttatttatttttttaattttactttttctttttttttattatactttaagttttagggtacatgtgcacaatgtgcaggttagttacgtatgtatacatgtgccatgttggtgtgccgcacccatcaactcgtcatttaacattaggtatatctcctaatgctat

SEQ ID NO: 91476 - DNA, 109 bp, Homo sapiens
gctatctccaggtaggtggtgtcagaactgaactgaactgtagtcctacagttggtgtctaatggggaactgcttggtgtgtggagaaaaaacccacacatctggtgtc

SEQ ID NO: 91477 - DNA, 460 bp, Homo sapiens
ttagttaaactaagaatataaattatcccatgtagaacaaaatggcaaatgtttatatcaatgtgaataagaaaaagaacaatatataataagcttaaaaattattaagtattgctggatgtaatttaatacacacaaaactaaaacactattaaaaatcattttatactcaatctcaatttgtaataggtaaaaatagtatgttcaacaatgctataataagccccaataagattagattctttggtttaatttcttcatgttgtggaagatgtaacctaggggacgttatatttgactgatggaccttcttttctacttaggagctgatacacatttttttctacttagttgacatctgatatgagttagacacattgcaatcaattatatttgtgcctcaaaatagcctttgaaattatgttgcaatgtgaacactggttaaatacaataatagtat

SEQ ID NO: 91478 - DNA, 933 bp, Homo sapiens
gtcggggctgagaccagccctgtgtcaaggtcagttaccaggacggtctccggaggccgggattcgcggagggtccaccagcaggaagaaaccccaggaggaagaaacctcatgacagatcgccggggaggcagcgcgggatcccaacctcaggcgtgcgcggacggtgtgcggatccatgaggaatctccacactgtcttccacaatggtcgaactaattttcattcccaccaacagtgattcaaggtcagccaaagaggagcaaagagtcatccacctcaatcatgttcaggaaatgatcaggtcaagatgtggagtgagccagcttttctctttcgtgccacattttctgacccagcatttcaagctacccaaggtgcgaaaaagaaagaaggccaaagggaagaaggtggtgctgacccttgcggtcttgaaaaagcaggagaccatgaaagtggtgaatcttccatttgagaaatttggcactggacaggacattttggcattggacagaacatccagcccaaaagggacctcacttgctttgtcaaatggccccattatactaggttgcagcagcagagagccatcctctataagcagctagaagtgccttctgtgattagtcagttcaccagggccttggaccaccaaacagctgctcaatggggtaagctggctggcaagtacagaccagagacaaagcaagagaagcagcagagactgttggcctgggctgagaagaaagcaaaggagacatccccactgagagatcacctgtccttttaatgggggttaacgctgtcaccaccttatcggagaaaaagaaggatcagctggtgatgactgcacaggacagagatcccattgagttggttgtcttcctgcctgccctgtgttgtaaactgggggttccttactgcattatctaa

SEQ ID NO: 91479 - DNA, 621 bp, Homo sapiens
tcaccatgttggccatgctggtctcaaactcctgacctcaggtgatccgcccgcctcggcctcccaaagtgctgggattacaagcgtgagccactgtgcccggctacataagcatttttaagctcagtaagccccaaactaagctcaccttcccttcccaaacctgattgtgtattttctacctttttgaacacctttttgaacctggtggggctgcctgttaaatacttctggaaaaacttaagtcaaagggtacttttgtgaaagtacctccttccccactttcctcctgttttctattactatagttctatcatggtacctacaaacattttattgtactttatctgttctccccagtagactaaaagcatctcgatactttgtccttggggaagcaagcaaatcaatgaaccaatgaatgaatgcatcttgagggttttccattgccatcctgcacagtgcctagcataaacagttgagaggtgactgagggtacctccaactaaacacatttaaaatggaactcaccagtttcctccaaattgctttcctccaaactttctgctttaaaatgacttgctgtgcacagttgatagcgtcaccatcttttcagttcac

SEQ ID NO: 91480 - DNA, 2582 bp, Homo sapiens
cgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91481 - DNA, 2394 bp, Homo sapiens
cgcgctggaaatatgaagagacgctgcagctgcggtggcggtggcggccactgcagctcagagcggcctggcccggccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91482 - DNA, 2319 bp, Homo sapiens
gctctaccagttccagctgttcaccttgcctgcgggccaggacctcgcccagcccttgttcatccagtcagccaactagccctccgacgggcagtgccccccaggtgacctggtgactgatgggcctgagctggcaaggccaaggacacccaacacaattttggccatacagccccaggcaatgggcacagccttcctccccagaggacccggccgacctcagcgcctcttgcaggctaggacactggtgcacaagttgtcgagattcgaatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91483 - DNA, 1866 bp, Homo sapiens
cgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91484 - DNA, 2454 bp, Homo sapiens
cgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagactcaagtggtgtggactcaggtgtgtggggatcctctag

SEQ ID NO: 91485 - DNA, 2428 bp, Homo sapiens
cgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91486 - DNA, 343 bp, Homo sapiens
ggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaaggtacctcagagctctgtgttc

SEQ ID NO: 91487 - DNA, 2418 bp, Homo sapiens
cgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggcaccaaatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91488 - DNA, 1908 bp, Homo sapiens
tggcatcgtcagacctcagactagctgccgttgcgcttcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91489 - DNA, 1713 bp, Homo sapiens
attcgacctcggtaccctctgtggggccttcccagcaacagtcagcccttaagctgacgtttcccattctccgccctgctccatccccatctcacctatgatctatcttactatttagttcaatgtctttctccccacagagagagcctcgacgctctctctgtgggctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91490 - DNA, 1962 bp, Homo sapiens
cgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaatt

SEQ ID NO: 91491 - DNA, 1101 bp, Homo sapiens
cgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctgcttttcttgcctaagatttctttcctgatcactatgcattttaaagataaacaattttaaagtttttcagatgctttagagaggatttttttccatgaactgcattt

SEQ ID NO: 91492 - DNA, 243 bp, Homo sapiens
cttaattaaatggtaaaacgctacctgttttagtctcttctgtacataatttacacttttattcagaaaggcaaagcaattactgatgccatatgatcctgttcagtaaattctactctaaatgtggtaaaagacaaatgattaagtaatagcctgttgtttttccttctagtaaacatatatttattttatgcctattgtatattaaatgccacttaaaaattaaaataaactcctaaactt

SEQ ID NO: 91493 - DNA, 460 bp, Homo sapiens
ataagaccctggatccagagctaaagaccacaggagtcgttggatacacaaactgaaagagactacagtgaaatagtaaaaccttcaaagttgttatagtaaatgaagactttaaaccatctgtgatgtgaaaaataaattaatgaagtataaagagatctaacaccgtaagataaacatttgaaagaagatggtaaatgcctaatggctacatagataatacagtaagatgtactattattagtattaattatttgttaaatagaagtatcctcaacattatacagaacagtcaataacagagcacctagactaaggccactcgatctgacttggttgaaaaacaattcaaacatgaaagaagccaaagtgattatattctagacatgtgagcttcatagagttcattgcaattaagggactataagctgatgccatagtacagtgaatagaaatagag

SEQ ID NO: 91494 - DNA, 773 bp, Homo sapiens
aaaatgggtttggtgaccgtctgttccagcacagttccagtttatctctattgtcacagcatgattattaacttcatcccattgcagtctcagaatggatctatagtcctggacataagagcaacctgatatgagaggtcacaggacagacttaaggccttacgaaggaaaagacttttgaactgacccataaaaggaacaggggcagagagggaaagtcatttctctgtctgttgcccagctcttcgtgaaggggagctagaagaagctacattttcctttagttttcagcagagcagaaaaaaattccaaacaagactatattaatgttctattgccactgtaacaatttaccacaaaattactggtataaagcaatataaatttatacacttaaattctggaggtcaaaagtctaaaatgggtccatgggactgcacatcatctagaagctctaggggagaatctgtttctttgccttttcctctttctagaggctgttcacattccctggctcataagcccttccactgtcttcaaaacccaaagcctatcctcttccctccaatctctgcatctgtccttacattttctctatatgtgttctgactcctgcctctttcctataaggacccttttgattacactgagctcatctgggtaatccggaataacctctgtaatttaagaggcttaatttaatcacacgtgtaaaatccctttcaccctataaagtaacatgtccacagctttcaggaattagaacatggaca

SEQ ID NO: 91495 - DNA, 404 bp, Homo sapiens
aaccacaggggtactgcccagtgtaaatgagttccctatgagagggacccctggtaatggataggatgcttaggcattagactgtctgctgggataaagacgtatcccgtaaaagatacgctgtaaacacccatgaccacctctcctgcatccccatcaggcagagctagaatttatattcactctcttgagacagacctcaagaccatgttagaagaaagtacaacactcatcatcctagaattatgattattccaattcagttcatccaaggtccctttaaaaatgcattggttaaagagtcagttaatattcttttttttggcatggtggcatgttggatgttgattttagtactaaaaataaataaataattacctaagtgtgtaaaataaacaaaaggc

SEQ ID NO: 91496 - DNA, 492 bp, Homo sapiens
ataaggcacccttcttcactggaagctgatgccctaattttcttctgagtacctgtgatcacagcccatcctcccggcagccactgccagctgaagggcgaagtctgcggagaccttggagaggctggcggctgcgtgctcagggcgtctcgggccgactaggcaagcatggtggagtcacaccagggttttcttctcagaagtggaatctcaaagtgcatcttggccagagcatgtgtgtcgcccacagtttcaagtgtttatgactcacatggtggagaagcctgtgccgcgtgctctgcctggctacgcggtgctggctgcatggcttcgggcctgtgtgcacgcagggcggcctggccaagccctctggtgagacggggctgccggagtgggccaggaaaggagagcccggcttcttagggccctgcttctcgccagccccttcagccgctcgttcattcagctgtcgcctgctgatcgctgcccaga

SEQ ID NO: 91497 - DNA, 156 bp, Homo sapiens
agattcacaaaaccaagctgctccaaatgtagtcatacaatttctagtcagagttaagtatcagtcttaaaattaattaaaattaaataaaaattccaattagtgacactagccacatttcaagtgttcagtagttacctggagctagcagttatt

SEQ ID NO: 91498 - DNA, 601 bp, Homo sapiens
ctttttttaaaaaaataactttttatttctagcctcaaccatttacactttgcttgagaaagaataataaagtggaattgttattccagtgatgttgtgcaaatgtgagaaatagtacttcccccaaaaaaacaaacctcgaaaccccacaaactcaagtgtacttaagtacttaacgttcaagtactttttaactataaccaacttttccaccacactgttgtgaatatttgttgctagctgttatgggtataagtgatcaagggaagaactgatgcattacctaatgcttgactaaatatagccagcccttaagtaggtagagtatttggttgtgggttttgttgtttaagtctgtggagtccctctttggtttctttaacttttgcagtcattagggcagagtatatttatttacatttctccaagcaaagtcttgctctgttgcccaggctggagtacggtggcgcgatctcggctcactacaacctctgcctcccaggctgaggcaggagaatcgcttgaacccaggaggcagagtttgccatgagcctctcaccgttgcactccagcctgggtgacagagtaagactctgtctca

SEQ ID NO: 91499 - DNA, 283 bp, Homo sapiens
taatgaaaagcatattgccgtatgtaacataatggaatatttatcatcaatgtgtttttgtggctcttcagagccatttaatattaaccatataccattttggtaaatagttcaattctcaaagttcatatcactataccaaaagtggtattttaaaggaatcaaaatgtataaatctaaagtgtgagaccacattatggctcagtctagacaggcacgccaaatattactgtttatttgtgctaatgtgtttgtcatgctgatttcctcacttcttttttat

SEQ ID NO: 91500 - DNA, 649 bp, Homo sapiens
cttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaaca

SEQ ID NO: 91501 - DNA, 879 bp, Homo sapiens
taagtaacttttttctccatgctaaactttccacgtcttctatctaaaaggtccccaaaggcaccactatttggtgtgaagattttgagcagcacttagattgctgattttctgggaggttgcatgcctgtaagttgctgctgactctccttttaacccactgaactcccccaagagcctccacgccaaagtttcaccgttttctaaaaacatcttaagtccctgtagaattacgggtgtggaactggtgggttgcaaattcctataagtactggaggtttgaataagttgctaagaaacaagacaacaaggagaaagaaaacacagaaggttacacctgcaagagaaaaaaaaaatattagaaaccaagtacctggaataaagattccatttttggagcagctattctgcagatacttagcacagctctttcaaagcaagcacagcttcactttcccccaagcccagtgttgcaacacagatacatcacttcatccctttggtttgaggtagacttcttagggcaaaaggcgttttctccacatgcagaaagtcccttgctctgagcacatacgtacacacatgctctttctttgtatacatgctgactacacgggcaggatgcaaatcctggctgcagaaaggaggcaggtcaaatcagaaccccatccttaagccctccatgtgcccacaccatatctacagaagctcagggactggaaaagacagcaaaaggcataaaagtaagggcctgtcaattacattctgtgattagcatcgtggcaattggtcattcaggcctgaagcatgaagggggccaaagctggcatccctcacacagaagaatcacgtttcattggattttccaaaaaaaaaaaa

SEQ ID NO: 91502 - DNA, 451 bp, Homo sapiens
ctcagcctcctgagtagctgggattacaggcgtgcaccaccacgcccggctaatttctgtgtttttagtagatatgggatttcaccatattggccaggctggtctcgaactcctgaccttaggtgatccacccacctcggtcttccaaagtactgggattacaggcatgagccaccgcgcccagccctatagttattatttctattgcttttaccttgtgaagactaaatatttagcttctaatatacatgtcctagaaaacactatgcattttggttaaattccttgttactgtatgttataaaatagacagggaattgggtgaaatagattaaaatcacacaaacctggggagtcaagtttctcttgggcaggcttagaaaacacagaattggaaataccccagtgacatggagatcagaattctacctagggccctctccctgtccca

SEQ ID NO: 91503 - DNA, 593 bp, Homo sapiens
gataccaacttttcagagtgctgagaggatttgatggcataatttgtgtaagatgcctagccccgtgcctgcatgatctatactttggctgacagtccgtgccttcaggcagcctcacaagaatatctgagaacagacagtattgcgttgcatccaggatttggtatggacaacttatcctgctccctggtgccaacacaatatttcacaacagacaataaaactaaaggacacagcaggccaggaaagatacaggactatcaccacagcctattatcgtggagccatgggctttattttaatgtatgacattacaaatgaagaatccttcaatgcagtacaagattgacagaatttacaatttaaaagaaaacagaggaagaaaagtagaaaaaaagctggcatgacacaaaacaaaacacagaagcttgtgggaaccatgataacttactgatttttctggctgcaagattgtatgaaacaaaaaatagcaatatataacacttccagtttccccccgaagcaggcatgaccaagctcgttgtggtccagattgtctaaccagttatgctttaaaaaaaaaaaacattctt

SEQ ID NO: 91504 - DNA, 1066 bp, Homo sapiens
gcggccgctccaacatgttaccattctgatgttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttgggacacagcaggccaggaaagatacaggactatcaccacagcctattatcgtggagccatgggctttattttaatgtatgacattacaaatgaagaatccttcaatgcagtacaagattggtcaactcaaatcaaaacatactcttgggacaatgcccaagttattctggttgggaacaagtgtgacatggaagacgagcgggtcatctcaactgagcgaggtcaacatttaggagaacagcttgggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaatatgtgatcttaaatttataaggactatccatctataaacatctggtacctgc

SEQ ID NO: 91505 - DNA, 1432 bp, Homo sapiens
gcggccgctccaacatgttaccattctgatgttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttgggacacagcaggccaggaaagatacaggactatcaccacagcctattatcgtggagccatgggctttattttaatgtatgacattacaaatgaagaatccttcaatgcagtacaagattggtcaactcaaatcaaaacatactcttgggacaatgcccaagttattctggttgggaacaagtgtgacatggaagacgagcgggtcatctcaactgagcgaggtcaacatttaggagaacagcttgggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaatatgtgatcttaaatttataaggactatccatctataaacatctggtacctgcatgtgacttgttatttatttgtctgctaggctctttttgtttcaaatttgttctcagactacttctgggacatcagactataatctcactacaactggcttttgtcccattgattcaaattatgctattcacttgtaggaatgatgaccaaggaattgcttgtgtgtgtgtgtgtgtgtgtgtgcacgcatgcccgcatgcgtgcagaggaagaagtcacaagacttcatttgctttactcttagttgaaaatcaaatggaagtttttctcatgattagggacgctgtcacgagtctggtcagtttactgttgggaactgtgtctttatttcactgttattaataaactgagatcattggcctata

SEQ ID NO: 91506 - DNA, 3920 bp, Homo sapiens
ctggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtcccccactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccacccccatattaactgtaattttgtaagaagagtgacttgttggtttaataaatctctagttattgtaataatttattggctgccataatgtatttattagtcgcctaccgttaataaaaagtgcccgctttcct

SEQ ID NO: 91507 - DNA, 1058 bp, Homo sapiens
ctggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtcccccactctaaagggagagtcctaggactccttagaggaggcttcactgcggagatccctgagcagaagggggcggggtagcttctcccggtgacggtgacgcaggtctggctggccttgggcaaccaacacacctctcccaccccatattaactgtaattttgtaagaagagtgacttgttggtttaataaatctctagttattgtaataatttattggctgccataatgtatttattagtcgcctaccgttaataaaaagtgcccgctttcct

SEQ ID NO: 91508 - DNA, 249 bp, Homo sapiens
ctcagttgaaccagcaagaggctgagcctaactctccctttcgaatgggcaggagttcatgatatttaataaacagaggccttgctctgtaagagacagggtaccaggcagagagcaagtcagcatcgcaggagtcaaacgaggcagacagcgggggcagggagcttgcctctgaaggagacccaggctgccagagtagcagggagtctgggccagtcctcttttgggaagcgcttcctcggcttctgc

SEQ ID NO: 91509 - DNA, 510 bp, Homo sapiens
aagccaattgctttatctgttttgcttatcagagtcatattgaattctctaggcatcagcatgcaataaacttgttttcaaaggcactctgttaggtggcatacagccctgattaaaaacagcactgaacttagacatgtttcatttttttctctaacctagtaccttttttacagattgcatattaacagcttatttttgcatttacctctgtaaaccctcaatcaaaatttatttaaaatattgggagcttttagtttaaagtgatacctactggcccctcaaaacatccagcattaaaaaactaagactggcagtgaaataattatcaaaattataggaagaattttcatttagccagaactgaattgaaaaatccatttggtggccaggtgcaatggctcacacctataatcccagcactttgagagaccaaggtggacagatcacttgagtccaggagtttgagacaagcctaggcaacatagggagactctgtctctacaaaaa

SEQ ID NO: 91510 - DNA, 407 bp, Homo sapiens
atgagcttcttatatatgatctttatatggctttgtattgtttttgagcaagaaatttaaaaggcaatgctattattattattgaaataaaaaacaaactaaaggtaaaaagccacaggaaaagtaatggaagcagttcttcaattttcttgggaatgtaagaataaaatttcattttagatttcctttttgtgagtaataacctaatttttggtttttagattctgtagagaatacttctgtttgaaaaatatttattcagaaaaaaacttctgttggcttctttctttgttaacagtaccgtgttaattaataggtcttcaaagttatacaaccaatgcctcacacttaagctcctagaagtcactagggaccagacctataaacagaataaatgcaaagtgaaa

SEQ ID NO: 91511 - DNA, 724 bp, Homo sapiens
gctgccttcccgcctcgctgcctacccggccccaggtggcctgcctgtcccctctcccccagcagcctgccactgagcaggagattctcctcttgtctgctggggaagggtcttggtaggaagttcaggcctccccagtctgcccactctgccatgccagggtcatagacctcacagcccctccctggccggacagggaaccaagctcagctcagagctgggatgtccactgcttccacagacaactcccagggccctcggtctggcttttacaacaatcacatcgtctagatttgccaatactcacttcatcttgcagatggagggtggcactgagcgcctgcattgggctttgtccactcactgtcatctgccttccagggagccctacccggtgggcatctgtatgcccatttcacaggacagagtcgtccaatccctcccagaacaggggcccggaacaacagcccccatctaacttatcccagcaagcatttatcatcacctctgtgtgctgggacttgggaaggtgccaggagacagcagagaaggaggcgagacgtctggactctgctctgccagccaccactgctcagaacccttcaccaggctcgggctggcatgcctcagccctgcccttctacctttgcagatgctgtttctccccggagcgactccctgccacctgcaccaaccccactgccaccctgcctatgccacccca

SEQ ID NO: 91512 - DNA, 659 bp, Homo sapiens
aagaatggacagccatatggtttggatctgtgtccccacccaaatctcattatcagtcttaacccccaatgttggaggtggggcctggtgcccaggcgattggatcacaggggcagttttctcatgaataggtatcaccgtccctcttggcactgtcctcaggatagtgagtgattctcgcgagatctggtggttgaaaaccacgtagcacctccccactcactcttgctcctgctctcccttttcctttcaccatgattgtaagtttcctgaggcctccccagaagctgagcagatgccagcactatgcttcctgtacagccagccaaaatgtgagccaattaaaccacttttctttataaattacccagtctcaggtatttctttatagcaatgcaagaacagcctaatacagacagatacccttttaatcagtccatctacctaagtgcacatcagtagcagaatagctttgtggatacacagtactgataagtgaaatggtatgcagcagttggacaggaataagtagcactaaatgcgtagtcgtggacagatctccaggacactaggtgacaaagcaagttgctggataatacatgcactatgatcctatttctgtaaaaactaaataaaactttggtcagttaaaaaaaaaa

SEQ ID NO: 91513 - DNA, 373 bp, Homo sapiens
gcaacctccgcctcccaagttcaagcagttcttgtccctcagcctcccaagtagctgcgattacaggtgtgtgccatcacacccagcaaattttttttgtacttttagtagagatgggggttttgccatgttggccaggctgttctcaaactcctggcctcaagtgatcttcccgcctcggcctcccaaagtgctgggattacagacatgagccaccatgcctggcctctgaaggtcatactcttaaaagcttagacgaagagtcttagaacatctacggtaataataagaataaccattaatgtttattatgccccgcactgttctgtgtgtatttcatatgtaatctaatttaatctttaccactactttt

SEQ ID NO: 91514 - DNA, 448 bp, Homo sapiens
gaactatctgtggggaaagaagcccagagcggagagcctgacaacttggggcactttgactctgcagtactttgctaatgaggctgaggtactaagctgtgctagagctagcaagatgggctccccaacctggcaagagtggggaccctaaaataactcctgctatttgcaaagacaccaaagggctataatttaagagtaagggtgaactgggaataaactacccacctccccccaccacacacactcacaactttcagctcagcttcaaatatctgggtggcctgtaaaatcttcagtgctaattgttaattaagatttttccagactgctagagtccctagctcctggcagaagcaaatgaaaaaatgatctctttgctaccgctttctaggaattgcaatggggaatactttttggatgcccctgagtgagctttgaatggctt

SEQ ID NO: 91515 - DNA, 139 bp, Homo sapiens
gtgacctgttttaccactttctcagtcgccaggtccttagcaccccaaaattgttatttcccagtggaaagtttgtcttgtacaatgcttgctatatggttggaactaagtaaatgctttttgaatcatgaactaactc

SEQ ID NO: 91516 - DNA, 406 bp, Homo sapiens
ctgagatgcctcagagcaggagtgagtagcttaggctgtgttcatcctggctctggaggacagggaaggggatgctatccagtcataaagtgcccaataaacacaagtactcatctgggggcatatgaggaaatgccacaaagggataactaatcccaagcactggaaggactggcagtgcctacctaaatgattcactgagggaaagtatgttgtgtgtggagaataaggttgtcaggttttatttcatcattggcgaaattggagagaaatatctcctcatataagagagcattttggctgactgactgctaatggggtgactgacacattcaccccattcctcactgtggttccaatcaccctcacactaaacccatattgtaacctttgatgtacttggggt

SEQ ID NO: 91517 - DNA, 320 bp, Homo sapiens
ggatcccctgatattctttatagctggattgttcaaaccagaatcttactcaatactgctcattaaatctggttgttacgcctttttaaatctagaaccatctctttttttttttttttcaaatgacattgatttaacttgttcagggcttgttcctttatgccctgtgtatctattaacattggaagctagttctaaagtaggttcaagaatagcatcttccactggagtacttcataggtgctgctgtgtactttgttatcttacatcaggaggcacagtaactggctctgccatcagataaggaaagattgatacct

SEQ ID NO: 91518 - DNA, 424 bp, Homo sapiens
gaacatgctcataccttgtacagtaaagggaagcctcctccccatgtgaaaccctggcttggaatgaaggcacagcgtggggtaccgaccaaggctgggggagggcaccaagatagttcagcatctcagcaaacaaaatttgttttgtgtcaagctgcaagaatttgaaaatcaaccaagcacattttaaaaacctgttgttttctggatgttggggtttgggagagctgctcttcaataggtaaaaagcagttgttattactgaaagccacatatttgcataacaaccaaagtgtttgagagcacctgagaaaacctccccagggtccttgaaacacttcctctgctggcaccacaggtttcacccagcagaccttttcttcccaaatagtgcaaagccagatttcagctctcttctcattct

SEQ ID NO: 91519 - DNA, 212 bp, Homo sapiens
cattaagaatagtgttgaaaacatcaatttaagacacaagctaattatgtgtccctgatttctagaagagacatcccgaaccacatgttgatagttaataaagacgtgtaaactttttccctaagagattattggtaaattaatataaatttaagacacaggatagagtctggagatgacagagtatgcaaggaagttacataaacacaaag

SEQ ID NO: 91520 - DNA, 462 bp, Homo sapiens
taactgctattctgacatctaacaccaaagattagtttttacctgtttttgaatttcatataaatataatcttccagtatgtactctttttttcgtttcatacaatatttactcttgtaagcaaatcaaagtgacttttttttttttaacgaaagaaggttaggttactggattttcaattaaatcaaatctttagatttgtatattagtgaaataattcagtaaaataatcatatccatagctatccaaatctttctggataatccattctgttttctagatattagcacaatcttaggctcataaacagagctccacatcatttcattcctttttgtcatgtgatttaggttttattttattcgtatttaacctttaagttcaggagtatgtgtgcaggttggttatataggtaaacttatgtaatgggagtttgttgtacagattatttcatcacccag

SEQ ID NO: 91521 - DNA, 437 bp, Homo sapiens
ccggaagatggacctcttgagaactaacctccttattcaaaaggagaatagaatggtatcaaaacttcagccctaggacttaggaaaagtggtttcacatagagtaacaggttttcaataaacagctgttaaatcattatggattgtaagagttcagacctctcataagaaaattaagaaatttaactgcaacaataactctgtatgcagtagatgggccttgcaaaagtattaacacaaaacaagcattctaatagttgttaactgaacaaagagagaagcaaatgaaagatacataaagataatctagggaaccacgacagacatgtcttggggaaaatttggatgacacaaggaagactgcatgaaacatacagaaacactaaaaataatgttaggcagtcaaggacaggaaacatcaagcctcataccactaa

SEQ ID NO: 91522 - DNA, 364 bp, Homo sapiens
cttggcttcttaataaagaaaagacaactgatttgcctttaaatgaatgctttgtcctagccacactgggcaataattcagatcttatctaacagaatctgtcaatggtctgttttcagacttgcacaggtatttctcatttccgacaaagtagaactgatacctgtaatatttttcaagttatagttgtttaagtgtaaaaccataaagcaaaatgcatttggcaacaaaatgataccctgtacattcatgtataagagccaataatgttatgattacttgttatctactttatagttttattagcaaataaatattgggtcttttacttcagctacaaatttattatagaattatcatggat

SEQ ID NO: 91523 - DNA, 382 bp, Homo sapiens
gaaatttggtacagaaaattacagatagtacagattgagttcctagttgattataagtgaagctgtgatgtctaagaaaaatcaagaataattgtgattattaatatttcttgagcacttactatgccatgttactaaactaagactattttttgaatgatctatttaaatccatattgcagaaagcctaaaaggaagagatttaagtaatttgctcaaagttacttagcttttaagtggtagaaatggcatttgaattattgatccagagcctgagtgcctaactcaactacatgggtttcctagtggccagtattttccaaacttaaatcattcacaatttctgcttcgtcccaaaccatctgcctgttacttaatattt

SEQ ID NO: 91524 - DNA, 1174 bp, Homo sapiens
ccgttggacaaggacaataaataaaaaggcatgtagattgcaaaggaagaaataaaataacaccattcacatatgacgtaatcttttatatagaacattctaaggaatccactgaaaaactatttgagaactaataaatgagttcagtgaggttgcaggatacaagattaatataaaaaacaattgtattctatacactaacaatgaacaatctgaaaatgaaattaagaaaaccctatatactgaaaactttaaaacataattgaaagaaacaacacctacattaatgacaaatagtctcatgttcatggattgaaagacagtattatttacatggttgtacttcccaaattaatagagagattcagcacattctttataaaaatcccggctttttttgtagaaattgacaaggtgatcctaaaattcatatggaaatgcaagggatggagcatagccaaaataatcttggaaaatcttggaaaagtacaaagttggaggactcacacttccaaacttattaccaacctacaattatcatgactgtgtggttctagtttaaggatagacacatagatcaatggagtagaattgagagtacagaagtaaactcactatggttaactaattttcaacagtgatgccaagacaatggtgaaagaatagtctttttgacaaatggtgctaggacaactagataccacatgcaaaagaatgaagttggacccctacctcaaaaaaaatatataaattaattaaaatgtatcaaaaacttaacaacaaaactataaaacttttaggagaaaacatacatataaatctttgtataatcttatattaggtttttaagacttaacaccaaaatcacaatgaaaaaagaaaaaataggctgggctcagtggctcacgcctgtaatcccagcactttgggaggccaagacaggcagatcgcttggtcccatgagttcgagaccagcctgggcaacatggcgaaacctcatctctacaaaaaatacaaaaattatccaggcgtggtggcgcacgcctgtagtcccagctactcgggaggctgaggtgggaggacggcttgagcctaggaggcggaggttacagtgagctgagatcgtgccactgcactccagcctgggcaacagccagaccttgtctcaaaaaaa

SEQ ID NO: 91525 - DNA, 491 bp, Homo sapiens
caggtccagacagccaaggatttgtcatacccaggggcaggaaagctgtgactgggatacaacaggccaggcatggtggctcacgcctataatcctagtattttgggaggccaagtcaggcggatcacttgaggccaggggttcgagaccagctggccaacatggtgaaaccctgtctctactaaaaatacaaaaattaggctgggcacagtggcttaggcctgtaatcccagcactttgggaggctgaggcgggtggatcacctgaggtcaggagttcaagaccagcctggccaacatggtgaaaccccatctctactaaaaaaaaaatacaaaaattagctgggcatggtggtgtgtgcctgtagtctcagctactcgggaggctgagacaggagaatttgcttgaacccaggaggtggaagttgcagtgagccaagattgcaccactgcactccagcctgggtgacagagtgagactctgtcaaaaaa

SEQ ID NO: 91526 - DNA, 417 bp, Homo sapiens
ctaatgagtactaggcttaatacctgagtgacaaaataatctgtacggcaaacctctatgacacaagtttagctatataacaaacctacacatgtacccctgaacttaaaaatacaaaaattaggctgggcacagtggcttaggcctgtaatcccagcactttgggaggctgaggcgggtggatctcctgacctcaaatgatctacctgcttcagcctcccaatgtgctgggattacaggcatcaggcaccgtgcccagtcattagagcacatcttaattcagactgcctgcctatcaatgactcaaaagcagatgtaggtaatggctacattaccaaattggacagtgtggttctagatagtaacaacaaatagattgtatgcacgggggagttttgttaagtgggaaggtataat

SEQ ID NO: 91527 - DNA, 394 bp, Homo sapiens
tatatatttcctacccacgtcctggtagggcctgcagatgacactccagtagcaataagcacatgtagcacccagatgtggtttctaaatagcaacaaccactaaaggaactagtctcctcaggagacaagttgactccagaatggggatgatgttcatcaaagccttacaaagaactggcattattcccagacatcccattactgggtatatgcccgaaggattataaatcatgctgctataaagacacacacacacgtatgtttactgaggcactattcacaatagcaaagacttggaaccaacccaaatgcccaacaatgatagactggattaagaaaatgtggcacatatacaccatggaatactatgcagccataaaaaaggatgagtt

SEQ ID NO: 91528 - DNA, 233 bp, Homo sapiens
aaccattggaataatttctctgaaatatacatagaaggtagataattttataatctgttcacatgtattttctccaagaaccacatttccctcagccaaactcaaagccaattagagtaagggaaatgaaactttatgaggactaatttgatatttaatcatctaaatgccttctcttctgtttctcctgcctttattcctttatcccacccagacttaaggagcatgaggta

SEQ ID NO: 91529 - DNA, 326 bp, Homo sapiens
ggaatttgaggctgcaatgagctatgattgtgccattgcactgtagcctatgtgacagagtaagaccctgtctcagaaaaaaataaaatcctatttctggcagcatttctttgtttttaacttcttagccaatctataaaatactctgtacactgtaaagcacaaaaaacatgttatgaaaaggtcgctcctgacacttgaagccctagaagaagattagggtaataagcaattggtgaaccctgcagcgtttcaccctcttgggctacttaaatgacaagctccttgtcctataatcatagtgtgatcgtccttgcctagtataa

SEQ ID NO: 91530 - DNA, 461 bp, Homo sapiens
attgctcattcattcattcaacaagtgttctctgaatacctactctatactaaccaggatgtacaaaaggaaaaccaaaagcgcaaaaatcctcgatctcgtggaatttacattctaggaatctacagacaaataaataaaaaagtcctgttagatgacaatacatgttattaaaaaaaagacaagaagtgtgtgtgtgtgtgtgtgtgtgtgtgtgtgtgtgtgtgtgtgtgtgtgtgtgtgttggacagggcatcattctagacttttcttcctcctcccttccctttgatctgattagcaattgctttaccacctacctccttagtatttcaccttttcttactcatattcttcaaactcatggtgctactttaatttacacagacacaagaggtttctttctctacccctactaccccaattcattcgcctcactttggccagagaaacctattgaa

SEQ ID NO: 91531 - DNA, 460 bp, Homo sapiens
tcttccacagcgcttattataatccaacacaatgtatagtgcattcatcccacttattgtcctagaatgttagttccaggaggacagacaattttgtattttaacaacttcttatccacagtgccaagagatgtgcccagcacatatttggtactcagtaaatatttattggataaacaaatgaatttatcaagctacataatagcagaaagaacatccataaactggcaagctggcttgcaaaaagtctttcaaaccaattactaaataattaaaatttagggcaaaaactaacactaaaataacaggattggaaaaattaagccataatttcttgctcttatcacggcaggaagaagtgggggaagcactaatgctggatcagagaagccagaggttatagatggcagttacattaacaatgcccagtaatctagcctgttttgattgtttttgtaat

SEQ ID NO: 91532 - DNA, 536 bp, Homo sapiens
aaagcaaatatgcttaaatggcaccaaagtcagctcttagggtcaccaccagtatgttcagaactctctcccttgtcccccatcactctccccaccccttctgctaaatcagatgttaacatcctcatctgcaggccccagggacagacactcaagtggttattgctaaggatgtggcacaccaagctcaatgctattaggacatagtttcagctatttggggtttacacagcattctttgccaacttcattgaaaacatgttttcatgagaattcatctcattctacctactgctggctaaatttatctccacagagtttaacaacatggaatgattaattagggaccaagctatttcctgagtgctttgcacataactgtgattctgtgactctgtgattcactctcgttgcttcagccatctgtccctgaacaaaatgcatttatttatgttttctgtgatttgttgttctcctctttcaaagacataaacatgattgatttggaaaagcaaaattgttttttcctctcttta

SEQ ID NO: 91533 - DNA, 229 bp, Homo sapiens
aattagcataaacatacttaaaaggcaagtgatagagctaaaatatttgaaacataccaggttctatgaagatctttagcaaatggtaagaaaggcaaacaatctaatgcaaaaatgagacacacaagaaaagtacaagttgttaaaaaaccattggaaatattatttagtttttaaaaaatagtatatacaggtttatttgatttttctttcatcactgtaaactagg

SEQ ID NO: 91534 - DNA, 175 bp, Homo sapiens
aattcaaatttgtgacatcacatcccacgttaaagtcttcactgactttaaggtgaaatctgtactccttaaacaaggtccttagcagtctgcccttgtctctttctcttgtctcatctctaatacttaaacccctggcattttttcagtgttgtttttcttctgtgtatgttat

SEQ ID NO: 91535 - DNA, 195 bp, Homo sapiens
tgtcaaacagttatgatccttcatatgagaacttgtctatttaaaggttgttactaaattatccccaagagttaccttctgtaaactgtcattgcaaagcctttttcccttggtcctcttggatggtttctgttttccatgggccttctccagagttatcagaagttgtcattctcaggtagacatatacactat

SEQ ID NO: 91536 - DNA, 309 bp, Homo sapiens
ctttggaaggaaatcactatgcacagcccacactaaaggaatggggagttgtagtgtactttcttgggagtggtctacatgattaattgaaattcttctgcaaaggacagttgtccctttcgctttattagttcgatcatttatgtttatcagtgtggacacatgaatattttatactttgggttacaatttaatactgctttattttgttgctcaaattatcccagctttgaccattgggaactctttccgttatctcctgttcccgcctttgacatacccccatcaatgtgggttttgtgttttgtt

SEQ ID NO: 91537 - DNA, 264 bp, Homo sapiens
ggtgtgacggctcaggactgcatttcccagaggctgcagctatccggccaatgtagcctgaaactacatttctcagcggccactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcg

SEQ ID NO: 91538 - DNA, 212 bp, Homo sapiens
atagaattcaattttaaaacgatctccccactcctcagaaaagaaagaaaaacatcaataatgcaaaaaggtatcatctaagaactaagttcttagaaaagaacctactagtaatataaaaataacttctctcacgtggcacatgtgcttttacatgacctcacctatttatttatgtgatgcaatgaagttctgagacatgggtgtaggtc

SEQ ID NO: 91539 - DNA, 1656 bp, Homo sapiens
gcggccgcccgccgccgcgctcctcctcctcctcctccagcgcccggcggcccgctgcctcctccgcccgacgccccgcgtcccccgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaag

SEQ ID NO: 91540 - DNA, 1463 bp, Homo sapiens
aggcttggttaacccccagtcctggcatttatgtgtgtgtcttccttttacagtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaag

SEQ ID NO: 91541 - DNA, 1390 bp, Homo sapiens
ttttaggtggacaggaagtagaatttattggtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaag

SEQ ID NO: 91542 - DNA, 1677 bp, Homo sapiens
tgtcacccaggctggagtgcagtggcgcaatctcagctcactgcaacctccacctccctggttcaagcgattctcctgcctcctccgcccgacgccccgcgtcccccgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaag

SEQ ID NO: 91543 - DNA, 1569 bp, Homo sapiens
aaacataggtaggtagaggctggtttgaatccggccgaggccggtcccgcccgccatgcccggcccggccgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaag

SEQ ID NO: 91544 - DNA, 779 bp, Homo sapiens
aggacttatctctcactttattccctgttgctcgagcctctaacttagacttaattgccaaactagtctctgtctggtctccacacactcctccccactcacaccaagttcatgtctgacacactcgtttttcctagtcctgattcctatctcaccccactctgagatctttcagaccttggaattcagaattcagatacaaaaccaagcatctcagactagatccctgaatatcctgacagtgaccattcacagattagacctttacctatttcaaacaataagacctccttcataccatgttctgtgggccttgcagagacgtgtgcctggcattcatcctagacctttcctgaaaccaacagctcaattgttctgggcattcccttactgctaggacctgcctagacctcctgtcaagtgtagtctctgggaagcagtcatctgccattctttaaatggcaagttctgacaagaatggtcctaggccctacagaaaacacagatctgtacaggacatgattcacaccttccagaagcttatgctccagagaggaagctaagataactacaacaagactcaataagtactaacggcttaaagaagcagaagaaagaggtttatttgtatttttttgtatagtacttgagcagggccttaaaggataaagattattttaatgcactgagattgaacagtgacatatggaaaatggacatttaaagtggtgagaaaagcatagagtggagaagccagaaagggtacaaaattttccaaa

SEQ ID NO: 91545 - DNA, 322 bp, Homo sapiens
tctcggctcactgcaacctctgcctcatgggttcaagcgattctcctgcctcagcctcttgagtagctgggactacaggtgcctgccaccacacctagctgattttggtctcgatttcctgaccttgtgatctgcccacctctgcctcccaaagtgctgggattacaggcatgagccaccgcgcccagccaatttactttttttctgtgggctgttttcattttccgatagtgtcatttgaagcacaaaaattaattttggcaaaatttatgtttttttctttgtttatttggtgtcatatctaagaaatcattgcctaatc

SEQ ID NO: 91546 - DNA, 486 bp, Homo sapiens
ccccaagcctttcccagtctgtcttccttgtttctcagtaacttctctgcctctcctccattgtacttcatgtctttttctagatttcttttggtaaaaagcaaaacacactttttgagggcctacttttcccagggaacagctttacagagccctgagcaattttgtttgggatgtttggttagctcaaggtgtgcaatggcatgaaggagccagggagcagtcttccatttgaaaatgccgctctctcaaagttgagacagttgctttacttatctgaacagagaaccaaagagctgagtcacagagatgtgtggttaaggatgttaagtcgtaggaatgctagttaagtgtttatcaggtgttttttttttttaaataaagtggggaggagggtcaatcctttatgtaatttaattcaactagctaacagtcgtgctttatttcttagaatcattttaaaaataggtgcaagggagataatgc

SEQ ID NO: 91547 - DNA, 541 bp, Homo sapiens
caccctgggctctggacacagccagatcttcagccagggcaggccctttatcttatagcccagtggtgcctctctcctcacctaggaaacaaagccaacaggatctgcaccacctctgcctcccggacattggaaggactaaataagatcagagacctcattcctagatggaacgaggaatggtagcgaccacgatcctcccctcccaggatctgcgccacaagggaagatcagaaccttcagctgccagaagcactgcggcggaaatgtaggtccccatccaggctgatctgagcttggctttctggagcacgcaaacctcgatgcactgaactgctgccggacctcaccttgccaggcccactgtgctcacactcacacatcgctccatccactggaggctgcagaggcaagatccaccaagaagatggtcttcctgtccaggatgcccttccctgagagaagtgtatttaatcttaaattcagatgtttgtttgtctacccacttaaaacaccctgttgaataaaaattactcaagga

SEQ ID NO: 91548 - DNA, 438 bp, Homo sapiens
taattccactgacgatccagtgggtctttgtggcgtctgccttttctctttggtggcctaaatattttcttgttgtctttaatgtttttcagttttatcacactgtgcttaggatacaatttacatatttaatctttctcaattggaaatacacttccaattcgaagagcagctttcagctcattcgtctctcccatcatgatgccgttaacctccatcctccctgggcagcttcttattttatttaacccaatttatcatttgttcttcttcagattcgtctgctcttgtttcaagatttctatccttttcaaaaaataatttatttttacttttatgaacttatcctatttatttctttggatatctagcatgatttcgggacctctcatgctgttataggaatttattttaataacagaatgaacatgtgttcta

SEQ ID NO: 91549 - DNA, 146 bp, Homo sapiens
aacaacataaaccagttgacgatggctcttaccatctcctggatcaacgatctcaacagtggcgactgtggggaattccaaggcagccagcacgggctctgagagtaccacctgaaaggtttcagactgctcatgctccccatcac

SEQ ID NO: 91550 - DNA, 501 bp, Homo sapiens
gcacgaggggtgtccagaacaggtctgcatatcacagatgagctcacctggctcactacacgattaggtgagatgcagcaacaagttttagtgcaggtttggaacctgggatccgaaacacacacagaagaactatggagcttaaatggtacctgtagggttttctaggccagtcattccaagtacaaccccatcacttccaacaaaagggaaaaacagtaacagcagcatttgagtgagttctccctaaagtcaaatatattccattgaaagaactgctcctcataggccgggtgcggtggcttacacctgaaatcccagcactttgggaggccgaggtgggtcgatcacttgaggtcgggagttcaaggccagcctggccaacatagtgaaaccccgtctctgctaaaaatacaaaaaattagccgggcatggtaccacgcatctgtaatcccagctactcgggaggctgaggcaggagaatcatgtcaacccgggagg

SEQ ID NO: 91551 - DNA, 588 bp, Homo sapiens
gggtgtcccagggcaggggcaaaaaggtggagggagaccccaaatgtgagccaagtgaacaaactagtcacatgagaaagctggtctgctagaaaagttttgatcttgtcatagccacaactgccagtgccgtgtttcgacaagaaaagcttgcaagagcctcattttgtgacactaatagaagcgagttctcaggtgataacttatttgtcctttcactgatagctttcttggaagagccagggaagggaagaccgagagagagcagccgtctagctctgaccagcagaagatttcattatgtctgtggcaatttctttctttttggcttttttctgggggaaggggggacagagtctccctctgtctcccaggctggagtgcagtggggcgatctcagttccctggaaacttcgcctctcaggttcaagcgattctcctgcctcagcctcccgagtagctaagattacaggtgcccgccaccaagcctggttaatttttgtagtagagatggggtttcaacatgttgaccaggctggtctcgaactcctgacctcaggtgatccacccacctcagcctcccaaagt

SEQ ID NO: 91552 - DNA, 927 bp, Homo sapiens
  misc_feature (5)..(5): n is a, c, g, or t
  misc_feature (70)..(70): n is a, c, g, or t
  misc_feature (122)..(122): n is a, c, g, or t
  misc_feature (144)..(144): n is a, c, g, or t
  misc_feature (156)..(156): n is a, c, g, or t
  misc_feature (170)..(170): n is a, c, g, or t
  misc_feature (185)..(185): n is a, c, g, or t
  misc_feature (188)..(188): n is a, c, g, or t
  misc_feature (200)..(201): n is a, c, g, or t
  misc_feature (210)..(210): n is a, c, g, or t
  misc_feature (212)..(213): n is a, c, g, or t
  misc_feature (220)..(220): n is a, c, g, or t
  misc_feature (226)..(226): n is a, c, g, or t
  misc_feature (273)..(273): n is a, c, g, or t
  misc_feature (284)..(284): n is a, c, g, or t
  misc_feature (286)..(286): n is a, c, g, or t
  misc_feature (302)..(302): n is a, c, g, or t
  misc_feature (324)..(324): n is a, c, g, or t
  misc_feature (326)..(326): n is a, c, g, or t
tcttnactaagacccatccgcagtgtaccccgcccgccagtccctccgcctgaccccaagggcaagtccntgaaggatgagatgttctgcagaagctgcccgtggcaccacggccacactgnacttccggacctggggcccagntcagctgggtgncggtcttcctaacngggtacgcgggcccnttntcatctacctgnnaaaaaaatncnnagtgccnttcatntatggccacaaatatgacttaacgtccagtcggcaaacagtggtgcncctcgcctgcntntgtcactcattccacnacatcaagcgcctgatgaagangntcttcgtgcaccgcttctccacatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 91553 - DNA, 280 bp, Homo sapiens
ccattcatattgcgcgtgagcatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 91554 - DNA, 717 bp, Homo sapiens
ggaataattccggctagaaatccaacgtgcggtgaagtacgttgagttcttaggcttcatatcagggaacaactgacctttgggagctgaagtgggagatggacatcaaagaaagtgggtcagtaaagttccacgttaaaagctgattcaggcccgggtgcgggggctcactcctgtaatcccagcactttgggaggccgaggtgggtggatcacctgaggtcaggagttcaagaccagcctggccaacatggagaaaccccgtctctcctaaaaatacaaaaattagccgggcgtggtggcacaggcctgtaatcccagctactcgggaggctgaggcaggagaattgcttgaacccgggaggcggatgttgcagtgagcagagatcatgccactgccctccagcctgggcgacagagcgagactccgtctcaacaacaacaacaaaaagctggctcggtatcttttgtgtgtttgtactcttaggttttaaccagtctccacctacatcaacctcactcctcatggtaaagtactactattgttctaaattaactcctgagagtattttggtgttgctctaatagaagaaaggggctttaaacaaaggtgatttttccagggtcagagagcagaaagtacctgccatttgggagcaggagctgcctgaggaatggaacctaacaacataggaacggcataacggttcctaaaaaa

SEQ ID NO: 91555 - DNA, 481 bp, Homo sapiens
ggaataattccggctagaaatccaacgtgcggtgaagtacgttgagttcttaggcttcatatcagggaacaactgacctttgggagctgaagtgggagatggacatcaaagaaagtgggtcagtaaagttccacgttaaaagctgattcaggcccgggtgcgggggctcactcctgtaatcccagcactttgggaggccgaggtgggtggatcacctgaggtcaggagttcaagaccagcctggccaacatggagaaaccccgtctctcctaaaaatacaaaaattagccgggcgtggtggcacaggcctgtaatcccagctactcgggaggctgaggcaggagaattgcttgaacccgggaggcggatgttgcagtgagcagagatcatgccactgccctccagcctgggcgacagagcgagactccgtctcaaaaaaaaagaaagaaaattggaacctaagttcagagccagggggtac

SEQ ID NO: 91556 - DNA, 635 bp, Homo sapiens
caggcatacgtattttttgtttgtttgtttttggtgaagctcccaggtgattctaatgtgcaggcaagtttgagaaccactgcactgtaccattatcacaccaaagataattatggtctaatatgaaggccatattaaaatttccacaattttcccccagataccttttacatggttttgtttccaaattacaatgtatttggttgctatatctccataagtacagatgccagcggctcctgcactttgccaggcatccgttgagtgtgttgtatatgtttgagcaatatttttgcctgtacagcttttcttgagcacaaatgttgtatcagcatggatttggaaaagagatcaatagagaactgcaactttctaatccataatgcatttaagttcagatatgtgctcagagatgtaagggggaattttatttcatgttttgtgtaaatattgatcggagacccaaaagggcctaccttacagacctctggggttcaatggggcatggtgtgaaataacacacacttgaagtttgcaccttccccaggctgagctggtataacttgtgtgcatgtaatcatctctctgttatctgacaacaacaaggacaattctactttggtagaaatgtaagg

SEQ ID NO: 91557 - DNA, 2258 bp, Homo sapiens
agcggacattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctg

SEQ ID NO: 91558 - DNA, 1883 bp, Homo sapiens
ttagaagcgggtaaaataaaaatgaaatagatggaggcttaaccaccttgaatgggttatctgacagtaatacctttgtacagctgactgtcaaagtgaaggacaaacattgttcaaagaaacaccaacagaaaacaccaaagaaatcccaaccaggcttaaaaaccaccaatgaaaatcattgtctggggcagggttgagtgagcgtgcaagcgcctgtgtgtatgcacaacagaagaaagatcatggttgaatcttttgctgtcggaagctgtggacatatgtactatggtagagatgatgccttttcggggagtgggggaagcctcttccctggaaatgtttgctttgtcccaaatccccgtcaccaggtgatgcaccgggttaatccctttggtgtgcaaatggttttatatcttgctattaagaatagcattgtaataatgtaatgagaatattaataatgctgtctgttgcttaacccatgtgctgatatattcatcatacatgtcagctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctg

SEQ ID NO: 91559 - DNA, 1823 bp, Homo sapiens
tgaagatggaaatcaatgacttagaaaccaattaaacaatccaaatagcaactgataaatggattaaccctctataatgaaattcctctagcttttgtcttccgccttccccaggtaggttttctattcctggaggcaaagcagaggcatggaggaagtggaggccagagggaatcacattaaagtgggtgaatccgtttatcacttactgtctggatggtatttctgctcacatctctgcttcctttttcagatttgtaccgtatgggaccctgattaacgttagccagtgaataatgaaaggcagcagcagacactgggtctgcccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctg

SEQ ID NO: 91560 - DNA, 3883 bp, Homo sapiens
agtcttctccagtcctgctcctccagctctcagcctctgcacagccaccagggttgcaaagggagccttgtgcttggaaagctactggctccgcgacctctctccttctcttcccttcgttcacctatgcttcttttcatgaaagatatttggcaatagttgggtacttcaaaagtctcaattctgctatcaaagggatgcaaagcttttatggctagaatggggtttgtggtttatacggacttggtttgcccttccatgtctactccccactgagaccctgattctgctcgctgccctctcccttccctgcactgtttttcctcccttccctctgccgtgatagatgctaaggagtggggtggaggtgggaagtgggaagcaacagtggcgtataggaaaaagaaaatataccccgtgcacattttcaacatgtagttgaagaagcctaaattaggtactagaaaaaaaaaaaggacagaaacactgcctgatatgtgagcaagagcatgaaaatatagaatgattatctcagagcagaggaggtggggagcaggtggctggagagaggcggggtaggtaggcagggcgtccctggctcaccaatgcgtctggtccacatggcatttgggaaagcagatgggtcatgcttttgcaatgaatggtcagatgcttagggggcatttgtgctcctctggccaggaaagggaacagagtccatccaagctgccccccactcatctgccatggttgtccaccctgggggtttttcctctgaaggaaaatgaacccatcttttgcctgccatgaatcattgcagggcaggctgttactggctaaattaaaacccttggcagggcatcgactgtgtgcgaggcaatgctctaggtcctgtaggggctggaaaataaaccgcatgctggcctagccttcaagttgcttttcagccatgaaactaagctctgccaagcaatcgtgattgtaggtcaagtatcgcgccatcacggaaggtgtaagtatatgtaggtttctctgttgaggatgcgtgttcctcagtagaagacaagcaggtggaggcatccagtgatttctaccctgtggaggctgaggggtcgggggaagaaaacagatgacctcagcctagttgctttaatctgcttttccaagcactggatgcccttggatgacagcatcctcagcattaaaactggtgaactgatgaagtcacctggcctggagtgtgttgggcagccagtgtccccagagctgcttgtgggtttctggggtggaaggcagggaggtgcaactggcagggcctgatcagaggcagaaaatgacccccacagtggtcttttccctgctagagaaagcagagagcgggactgggggggtgggggcttcaagtacagattgggcacactccaccagaccccagcaaggtcagctgccccacgcctgtatctggcactgctggtgtgtgcagggatgaaacccagcatcagagaggttttcagcaaaccttccatgctcacctttggccaggtgcttgtcagatcctagcttcgtgctggcttagactctcagttgtttgtgttgacagcattaggaataaaccgtttgtttcatctttccttttctccacacgtgtcacagccagatttcagctttgagttattccctgaagaagccacaccaaccttgctttcaagcaaaatgcctgggcttgggggaaggtgtgtatctgtccatgtgtggatgtcggctcagagctatagcttctctgtggggggtggcccaagggaaggctcctctggggccctggatggcacatgactcccagtgaggagaattcaggtgatctctgtggaggtagtcagggacacaaggcttggctgtgagtctggttttaaagtgcgtgacagcctgaaaagcatgcaggggtttggtccactcacctacttgaaagcctgtgggcaacgttcttttgagccaagacttctctgaatggccctgctggtggaaggggtgaggcaaaggcctctgacttggaccctttccacaccagactggcagcacttcccccaggcagccagtggtgggccctgagccctcaggtccccagctccttgagggatgaacctgggagcccaagagccagtggctgagctctgagaaggctccatctcccacctgcccttgagcgcgctctcaggctgagaacacggtctcatcaggcgccttcctggcctgatgctgtgctgtctacgtcacacggtcgattcacaaaagccagaactagacctcaaccaggtcatctccccgttgccaagtgggttcagggtgagggcaatttgtaagctcaatttctctgacagccaagacatggagcatctctgctaagaagccaaaagaaattggttttcttcttctcattgctgaagcccctctgtgtctcttctcagggacaggctggtccagtggctttggtgagggcgcctccatttgtgaacgctgggattcctctgggtgggctttggcaggtggctcctatggtaggaaggatgaccaggtccctgggaatgagctgcctacctgctgctccacgaggaagctcaggcctgcacaggctccaccaggccttggatgccctctagttgagtcagagaccctggaaacacactgagatctccaattgctgcctccattgatgtctctagacctgcagatacgaagcaaacctgggattgcttcttccaggtatgggcaccagagagggaggccactgcaacattttatccccatcattccaaaatgcttgcttgtctcttttacctcacactcacaactccttctgagactctcagtcataaaggaatgaccaagagagtgggtctccagtgagagaaatgcctatgaaagagggtttccctttttgctcttttgaacaccctccccactgatccttgggacccaacgccgcattgcctcttgcagatgaggttttgccttgggctgcttgggtacttcagaccaggactgagtctgacacagctttcatgaggttacagaaaagggctacagatttgggaagctgtgtgtaatggtcttgagacaatatctccatttggcccaccctggcttctctaaaaagcaacgacagcaacagacaaacaaaaagctcccacctcccaccccgttagctgtcctcctccttcactgtgatgtggttgcggtctctgtaggtgtgtgtgccacccttgtcctctgtcctctggggatgtgcccttcccacgtgtgtcaggttcccactctttcgtggttcctaacgtgaagtgctgtgatgtttctgccctgcctaaggaacgtatcaagctctctcagtgtttcagtgttggagattgaggctgtgccacatcttctgccatcctaaggggacatgatggttctgtgattcccagagagctggcagattgtgacaatctccaggagaacctacagattggaagcagcccacacctgatgtggactcctgacccgggactcactcttcattcagaagactggtggcccacgtgccaggaccaccccacctctcttgctgccttttctcctgtcctgatggggttctgggagggagacctgtcgctgatgagatgaagaatgtggggatcgagcagccttcttctttgggacccctcgatatcccatggaatgctcgcacgttctcaaagactgagtcacaagcccctaccccttccttgctgtggttagtatcttgttctgtgattggttagcaatgttgactacccacgtagtgaatcttttgtctgcaatttagagaatgtgtaaacaaataaaaggctttaaaactcaaggaaactct

SEQ ID NO: 91561 - DNA, 1409 bp, Homo sapiens
agcggacattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctggtgagtgtggccccttcccacaccgggtgcccgtagaccaggaatgctcctcttgcattcctcttccatcttgtggtgctggagactggagagggaagcgatggtggcaatgctttcgagtggagaggagttttcagctcattctgatatttttcttctttgggtctcaagaaccaaaagttatgccctaggatccgggggaaagggcaaagagaagttttgggtttgtgtctggcctttccatgaggtgcatatttctttgtgcgtgtttttacggaccacagcgaggtagagtggaaaaacctggagagaaggcaacgtgctttcttgtagtggatgatgcacatgtaacagaaagatgagtttgttctgtggaagtgcctagggcaaacccgaagagtgtggtgtggtgtggaaacatgagtattcggagagcaaccacatcttgaattgtgggagtcagagatccccgggctcctggctagctgcataaacaccaccgccattggccactaatctc

SEQ ID NO: 91562 - DNA, 4138 bp, Homo sapiens
agcggacattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgctgccctctcccttccctgcactgtttttcctcccttccctctgccgtgatagatgctaaggagtggggtggaggtgggaagtgggaagcaacagtggcgtataggaaaaagaaaatataccccgtgcacattttcaacatgtagttgaagaagcctaaattaggtactagaaaaaaaaaaaggacagaaacactgcctgatatgtgagcaagagcatgaaaatatagaatgattatctcagagcagaggaggtggggagcaggtggctggagagaggcggggtaggtaggcagggcgtccctggctcaccaatgcgtctggtccacatggcatttgggaaagcagatgggtcatgcttttgcaatgaatggtcagatgcttagggggcatttgtgctcctctggccaggaaagggaacagagtccatccaagctgccccccactcatctgccatggttgtccaccctgggggtttttcctctgaaggaaaatgaacccatcttttgcctgccatgaatcattgcagggcaggctgttactggctaaattaaaacccttggcagggcatcgactgtgtgcgaggcaatgctctaggtcctgtaggggctggaaaataaaccgcatgctggcctagccttcaagttgcttttcagccatgaaactaagctctgccaagcaatcgtgattgtaggtcaagtatcgcgccatcacggaaggtgtaagtatatgtaggtttctctgttgaggatgcgtgttcctcagtagaagacaagcaggtggaggcatccagtgatttctaccctgtggaggctgaggggtcgggggaagaaaacagatgacctcagcctagttgctttaatctgcttttccaagcactggatgcccttggatgacagcatcctcagcattaaaactggtgaactgatgaagtcacctggcctggagtgtgttgggcagccagtgtccccagagctgcttgtgggtttctggggtggaaggcagggaggtgcaactggcagggcctgatcagaggcagaaaatgacccccacagtggtcttttccctgctagagaaagcagagagcgggactgggggggtgggggcttcaagtacagattgggcacactccaccagaccccagcaaggtcagctgccccacgcctgtatctggcactgctggtgtgtgcagggatgaaacccagcatcagagaggttttcagcaaaccttccatgctcacctttggccaggtgcttgtcagatcctagcttcgtgctggcttagactctcagttgtttgtgttgacagcattaggaataaaccgtttgtttcatctttccttttctccacacgtgtcacagccagatttcagctttgagttattccctgaagaagccacaccaaccttgctttcaagcaaaatgcctgggcttgggggaaggtgtgtatctgtccatgtgtggatgtcggctcagagctatagcttctctgtggggggtggcccaagggaaggctcctctggggccctggatggcacatgactcccagtgaggagaattcaggtgatctctgtggaggtagtcagggacacaaggcttggctgtgagtctggttttaaagtgcgtgacagcctgaaaagcatgcaggggtttggtccactcacctacttgaaagcctgtgggcaacgttcttttgagccaagacttctctgaatggccctgctggtggaaggggtgaggcaaaggcctctgacttggaccctttccacaccagactggcagcacttcccccaggcagccagtggtgggccctgagccctcaggtccccagctccttgagggatgaacctgggagcccaagagccagtggctgagctctgagaaggctccatctcccacctgcccttgagcgcgctctcaggctgagaacacggtctcatcaggcgccttcctggcctgatgctgtgctgtctacgtcacacggtcgattcacaaaagccagaactagacctcaaccaggtcatctccccgttgccaagtgggttcagggtgagggcaatttgtaagctcaatttctctgacagccaagacatggagcatctctgctaagaagccaaaagaaattggttttcttcttctcattgctgaagcccctctgtgtctcttctcagggacaggctggtccagtggctttggtgagggcgcctccatttgtgaacgctgggattcctctgggtgggctttggcaggtggctcctatggtaggaaggatgaccaggtccctgggaatgagctgcctacctgctgctccacgaggaagctcaggcctgcacaggctccaccaggccttggatgccctctagttgagtcagagaccctggaaacacactgagatctccaattgctgcctccattgatgtctctagacctgcagatacgaagcaaacctgggattgcttcttccaggtatgggcaccagagagggaggccactgcaacattttatccccatcattccaaaatgcttgcttgtctcttttacctcacactcacaactccttctgagactctcagtcataaaggaatgaccaagagagtgggtctccagtgagagaaatgcctatgaaagagggtttccctttttgctcttttgaacaccctccccactgatccttgggacccaacgccgcattgcctcttgcagatgaggttttgccttgggctgcttgggtacttcagaccaggactgagtctgacacagctttcatgaggttacagaaaagggctacagatttgggaagctgtgtgtaatggtcttgagacaatatctccatttggcccaccctggcttctctaaaaagcaacgacagcaacagacaaacaaaaagctcccacctcccaccccgttagctgtcctcctccttcactgtgatgtggttgcggtctctgtaggtgtgtgtgccacccttgtcctctgtcctctggggatgtgcccttcccacgtgtgtcaggttcccactctttcgtggttcctaacgtgaagtgctgtgatgtttctgccctgcctaaggaacgtatcaagctctctcagtgtttcagtgttggagattgaggctgtgccacatcttctgccatcctaaggggacatgatggttctgtgattcccagagagctggcagattgtgacaatctccaggagaacctacagattggaagcagcccacacctgatgtggactcctgacccgggactcactcttcattcagaagactggtggcccacgtgccaggaccaccccacctctcttgctgccttttctcctgtcctgatggggttctgggagggagacctgtcgctgatgagatgaagaatgtggggatcgagcagccttcttctttgggacccctcgatatcccatggaatgctcgcacgttctcaaagactgagtcacaagcccctaccccttccttgctgtggttagtatcttgttctgtgattggttagcaatgttgactacccacgtagtgaatcttttgtctgcaatttagagaatgtgtaaacaaataaaaggctttaaaactcaaggaaactct

SEQ ID NO: 91563 - DNA, 397 bp, Homo sapiens
aaatggggaagaggaggagctgcccaaggaaagaggacaggaagggagagagagaagcagacagacagatggactgggcctaaagacagcatgagctcctgggagagggacttgtggtagaggccaggggagactgcctggggtcacctggtggttggtttgtccatgatggaaaattttgtctcaaatgaggctgtcattaggatgcacatggatgtccctctgacataagttccaagaaaattaaccaataggaactgaatgataagacatgaaacagattcctaattaagttacctgactccagactgactgcagctgcaggttctgaaatgggtttgcatgggaggctacaggcagtatggaatgggggaaaataacggggtttttggtcaat

SEQ ID NO: 91564 - DNA, 661 bp, Homo sapiens
tgaagggagaagctggggctcagggaggttaaggaaatggctagcttagagtcatgctagaccttggtctagatgagcctttaaactagatgtccttgctctctagagtatggtttgaaaattttaaacaggttgtgtttaaaaataatctcatgatagcctgctaaccttatatttttgaggaagtttgaatcagttctgtagactggcagaggggaaagacacatgaaacccggaaggagcatttactgagaacctcatgggaaccgcatatgttatggagacatggagacgtgaccgtctgctactgtcgtctggaggtgacctagtgactttatgaccaaatcaggtcataaagaggaaagaaaaacattgacgatcctacatcctaggctccttcccgacttctgacatcgctgttcagcccacactcacagtagttttgttttccttgagtatttaaagatgacaatgcatccgaagacaatctgtaaacggtaaggtaatatataaatctgacctgttcatagcacaataaacacagcaagcaaataaactccattaaatgtaattttaatttattcagtggaaaacaacaaagttgattcaaaagtcaaagacctaagagaagataaatccaaactctataaaaccttgattg

SEQ ID NO: 91565 - DNA, 421 bp, Homo sapiens
catccctggcctccattccccctcctcgtagttgcaataaccaaaaatatctccagatattgccaagtgctccctaggggataaaattgccactgacctgggagaaactgaactgcttgctcattcaccttcccaagtgctggggaaggacgctgactgcctagcttttggctcaaatgtggctgaataactagagcacgcttgcactcacaaggtgaccccttcataagcttgtggtttaaggagttgttgctctttaccactgctatagggctttccctaaaccctctaagtcagtactgtccaacacaactttctgcaagaagatatccatcatgtgctgtccaaaacagcagccactagccatatggggctattaagcacctgaaatacagctcctattatcgaagaactgcatttt

SEQ ID NO: 91566 - DNA, 368 bp, Homo sapiens
gaaacaagggaattctaatatctgctgtgttaatactaatatctgctctattgctataggaccaattgctgcgacagaaacccaaaataagagtagcagagcaaggcaaaaatttatttcctctattcctgaaacaagagcttgagaaacccatgcccctgatatggaagctctagtgttaggaactcattgttctgccagtgccatagccagtgacgtagccgagtctgtctggggtaggtggcccatcatcacattctgctggatctgctggatccacattccagctgacagaagggaaaaaaggggagtgaaacaaggacttctatcttttatgggcatactcagcattgtgttagagctggctt

SEQ ID NO: 91567 - DNA, 285 bp, Homo sapiens
ttactctgaggttctcgcggcaagacccaaatggacagtgatttggctgccagctggtgttaaaaacaagccaactccaagaaagttatggattacctctaagtgagaaaaaggaagcattagaacaacaaagaaaagaacaaaagactcaagttctccagcccccaaaattattccatctttatgaaggcaacactgatctccacgagcacaatcatccaaacggagatgggaacccctgttctaactctctcagaggcctgaagttagttttctagcactctc

SEQ ID NO: 91568 - DNA, 478 bp, Homo sapiens
tagctaggaccacaggtgcatgccaccacacccagcagaaagcggtttcttgagatggaatctactattggtaaagatgctgtgaacattgttgaaatgacaacaagggacttagaatataacataatcttaatttataaaacagtagcacagtttgaaaggactgactccaattttgaaataagttcctctgtgggttaaatactatcaaacatcatcgcatactacagaaaaatctttgggtaagggagggtcaataaatgcagcaaacttcattgtttaagaaattgccacagctactccaaccttgagcagccgccagatgagtcagcagccatcaatactgaggcaagaccatagctgggtgcagtggttcacacccctaatcccaactactcaggaggctaaggcaggaggactgcttgaggccaagaattcaaggccagcttgagggcaacataatgagattccatccctt

SEQ ID NO: 91569 - DNA, 872 bp, Homo sapiens
tggggcacactcacactgatggtgatgggcagctatgcacaggaaatttggatgccactttgtttgcaaggcctgggacttcagtgttcacgttcggaggcctttgggaacaaacctttggggtacaggtcatgcagcagcatgcatcctggcatgcgcattgtctgtgtcatgagggacacaagccatcaagccagtcggcacatgtgcagagggtgcctctgctagtgggagtcctttgagcatgtggcgtccatattaggagggccacagggtggtggtgactgggccagggttttgtggtatcctaaggactgtgttatgggcatatggcgtggacagagcaccctccaatgccctcacacccacactgctgaccaccgtgtcgcaattgtatccagcaggcaacgctcccttttgcagtgtccatcccatgtcccctttttagtatgttcctctaattaggtcctgaggcttctgtctctggagagtggctgtaaattctagctctgtcccgaccaagaggagaggtgttctggtgtgttgggtgggttaggtacagaaaaggcaacacaacaaaacacatcaagtagcagaagcattttattccttacagatccgcgagaagagggttgcccttgaggtcctgacagcaactcaggagacagccgggtgctaaccagtgggtggggaatgagacagagaggacctgtgggactgtgcctttgttacggtccatgggccttatccctcaggctttcccagcgtggttgtggattaggtagacctgagcagtggggagaactgatttacatgactgatgttggccagtaggtttcattatggtcagcagctgtggggtgtgttgggtt

SEQ ID NO: 91570 - DNA, 448 bp, Homo sapiens
ggccaggctgggctcgaactcctgaactcaggtggtctgcccacctcagcctcgcaaagtgctgggattacaggcatgagccatcacacccagcttttttttaatgccattttcacacaagaatgtctttgatgaagtagcaaaaattgtcagttttattgaattccaaccctgagtacggatctctttaatattctgtgtaacaaaatagaaatgctcataaagtacttctgcggcaaaccaaagtatagcacctgactcaaggaaaagcaaggaaaagcacatgtgggatcccttgaatggcaagtgaaactagccactagtttcatttttacatgaaacaatggctgtgttgggtgctgaggctggaaggtagacaggggcttggggttggagagcctcgtgggctgcgtttgtgcttgggggccttgagcgcagcccacctttg

SEQ ID NO: 91571 - DNA, 410 bp, Homo sapiens
ctccttgtactgatgacattccaaagaagattctcccgttatctttgagttctcacttttccaactctcagctcattcctatttttattgttatacctgtcaccaaaatccacatggtggaaaagaatgatcctccatttttggcaaggaggtttaaaggatcttcctccatgattgctttcatcacagttgacccaaagctatagaacaatacttttaaacccccaccaattctttcagatgatgaccaggagccatgtgtcttactgaacagaaacctctaccattcatccttccctgaatccaacctccagactaaggtctgggcatgtacctccttcttctgggtgtctccatctgttgaatgtccttgctcaacatgctggtaagaaggaaatgaacttttgttg

SEQ ID NO: 91572 - DNA, 443 bp, Homo sapiens
ctttgcgactggttcagggctctttgggggagccgaggctgccgaggttacccgggtttctttccccttttaggtttccctggcgagtcgtctggggtgggcaggcctctgagaaggtgggattcacggcctcatttctagtttcttgggtcctggagttcctttgcttgtgctaactcgtgcagtgtgcgggccggcctgtttcacttgaggccgaggaactctcaagaacaaaagctacttgcttttcctccttgggcccctccctctccccgtgctcctccgccgtcctcctctaaaactacctgggaggggggagccttccccgtcggctctggaaagactcctgaggaagtcgggccctccttactgtcttgtcttataaaagtctgcaaatcttttcaagttttcttaaaacaagtgcactttcagctccattcctg

SEQ ID NO: 91573 - DNA, 448 bp, Homo sapiens
gagcgatcaaatggaggaaggtgtacaagggggagtcgtgcctagacgtggggatgcatgctacactgcgggtgaaccttgaaaccatgatgctgagtgaaagaagccagacacacaaggccacatagtgtacgattccactttcatgaaatgcccagaacaggcaaacccatggagacagaaagcagattggtggttgccagaggctggaaggaggggacctggggagaacctactccatgttgatggggtctccttttagagtgatgaaaatgttttggaattagatagaggtgatggtcgcacagcactgggaatgtcctaaatgtcagagctgcctactttatagtggttaattttatgtaatgtgaatttcttctccatttgaaaaatgtgggaactaaaaaaatggagtagtccccccttaatcttgggggatatattctaa

SEQ ID NO: 91574 - DNA, 349 bp, Homo sapiens
agctgggttcgaggagaaaggccgagaggactccagcctgggaatcctcctccttgaccccgggtagatgtacagggtagagatacgtgggccaggttaaagccagaaagctggggtgcccggagcgtctcgtcaggtcccagacttgctccctctgggcagtttcctgggacttgcttcctcaccccagggtcagctcagctaagccccagagaccagctcttataaagagggatttcacaggaaatttggaatgtctggcttctcctaatgagggctgctcacacattgcgggtgggaatgtcagatgtgcagtgcagccactgtggaaaacagtcactaggttaaa

SEQ ID NO: 91575 - DNA, 409 bp, Homo sapiens
tgaggtggaagaattgcttgggccgtggttcaaggctgcagtgagctgtgattacaccactgtacgccagcctggggaacagagtgagatcctgtctcaaaaaaaaataaatgaataaataaaaataaaaaacaaaaaagccaggcatagtggccgacgcctataatcccagcacactgcggggggctaaggctggtggattgcttgaggctacgagttcgaaacaagcctgggcaacatggcaaaaccccatctctacaaaaaatacaaaagtttgccgagcatggtggaatgcgcctatagtctcagcgccgggggaggtggaggtgggaggattgcttgagcctgagcctgcgggtcgaggtctcagtgagcggagatcgtgccactgtactatagcctgggcaac

SEQ ID NO: 91576 - DNA, 222 bp, Homo sapiens
taatccactggcttccagtggatttttttagtgtcaagaaaataattttgattggttcatctttaaggaatgtgttaagaataaagcatgtctacctgtcttcagtataccagctaactatagtaggaagaaatatagtagtctacttagatcaactataattctttaatgcagaaaaagtttaaagtatttaccttatttttagcccccatccccttaagt

SEQ ID NO: 91577 - DNA, 356 bp, Homo sapiens
agactgccattcaggaatggctagcactcaacctttctcagggagatctcaggaagtaaggcataaagagagatggtgggagatttatgtggatgggatcggggcccagggaagctaaacagaatccctcaaggccttttccacactgtagaaaattgtgctggcatttggacaagtcaccctgcttaatatcaaacatctttgccttaagcattattttttcaaaggaaataacgtgttaatacttcccaaccagtgtataatgtttctgtttgttattagctcgtactatttaagttcagttgttaagtttgaaaatactagaacattaaaaatctgcagaatgagaaattatt

SEQ ID NO: 91578 - DNA, 315 bp, Homo sapiens
ggacagtaaagtccttcctggggtggatgctctcggcaatatttagtacttttctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatctttactgcaccctggatttgcctacattcttcaagatcccatttgaatttcttagtgactaaaccattgtgcattctagaatgcatatatgcatattttgcctgt

SEQ ID NO: 91579 - DNA, 428 bp, Homo sapiens
  misc_feature (405)..(405): n is a, c, g, or t
  misc_feature (407)..(407): n is a, c, g, or t
acccgaccaccgcccagctgagcccccgcggctccactgcgcagaaggtgcactggaggccctgcccgttgcccgccccgcggggtgccgagaagtcaacctgaataaacgccttgtaaaaagaacttcctaatggaaaaaatatcttatgatttccattctcaacgctcttcagaggactaaaagataaaggccatgatggattcattcaacaagtcctaatcctgcgccctggtgtgtgccagaccctgctccccgcgaggggatccacgagcgaccctcaccagggcctgtcatggggtggggggagtggggagggatagcattaggagatatacctaatgtaaatgatgagttaatgggtgcagcacaccaacatggcacatgtatacatatgtagcaaancnctgacgttgtgcacatgtacc

SEQ ID NO: 91580 - DNA, 365 bp, Homo sapiens
tcaggggtaagttttcttccttggagactcttgtcttgaaaaagtgatactagatcaccatttggcaagataattacaaaaggcagatagagtaattattttacatagctgttatagggtgactaagatctcagggaatgactgtgttctgtaatccacttgccccactcaataccccaagttttatacaagccaaagatgcttggagcagaatctgctacctgaggctccagggccttggctaaggggaaactaatacttaactttttaagtggtcattgatgacatcccactcctttctgagatgggtatgatttgaaaggcaggtgtattcatggagagcagggcttgggacctttgctgca

SEQ ID NO: 91581 - DNA, 363 bp, Homo sapiens
tctatttagagacaggccctcactatgttgaactcaagcgatcttcccacctcagcctctcgagtacctgggactactggtgtgtgccaccgagcccagctcatgacccattttcaattctcatcttccaaaagaaaaagatttctggactcacgaatctgtagcaagatccaggactcaggagagaggacatgtggagctccatgacggtcagtgccaagtctctagtcctctggaatgaactcaattttaatggagcatgaagatttacctacatattagaggcattctacaaccttggatgaaaaaaagaaaaacacattctctgcttcaattccataataaatttggatttttcagtcg

SEQ ID NO: 91582 - DNA, 594 bp, Homo sapiens
ttcatttaaaccaacatagcctagttatttttagttagagatgaatttgctttgatgtgattttttttctttttctgcaatgaagctatgtccaaagaatgtacttttcttttctgtcccctgggttgaagcaattcttgtgcctcagcctcccaagtagctgggactacaggcacacgccaccatgcccaactgattttttgtatgtttagtagagacggggtttcgccatgttggccaggctggtcttgaactcctggcctcaagtaatccacctgcctcagcctcccaacatgctgaaattacaggtgtgaacaaccacgcctggccagaaagtacttttcgagaagtttcatatagattcttttcctgttgcttagaaatagatggcagttattcagagaaccagagaaactaaagtgtgtacatttcccagtcaaaaaaaaatacgataaaaatattgactatgagcagatatattgtctggattgtctgttaattatccgtgttcacatgcagtgagtaatatttggcacatttttttctacattccttattttcatccagagtataattaatgtcttaatataccag

SEQ ID NO: 91583 - DNA, 145 bp, Homo sapiens
tcactttttgattcatcagaaccggggtttagcaaacacagtcagcaggccacatctggcccaccaccagattttataaagtaattgggatacagacaatctcatttatgtattatctgtggttgcttttctttaataaatttca

SEQ ID NO: 91584 - DNA, 182 bp, Homo sapiens
gcagtgtggaggtggcccagggacacggggtgcctactgtgttttgcctgaactgtgttttaagaggctgcataaccaagcagttgctgtgcacgtacagcttggcatctgagtctcccaccccccggcaccccatgtttgttacctgcctggtgcctgtaggcatttgagtttgtagcccc

SEQ ID NO: 91585 - DNA, 110 bp, Homo sapiens
caaagcactgcagtaaaagaaggcaaataaatgtttcattaaaaaattgcttgctttcactctaatgccttacagagctgggagctgtttttgatatgcatatgccgatc

SEQ ID NO: 91586 - DNA, 631 bp, Homo sapiens
tgcaacctccacctcctggcctcagcgtcccgagtaattgggattgcaggtgtgggccaccacgcccggctaatttttgtatttttagtcgacagggttttgccatattggccaggctggtcttgaactcctgacctcaagtgatcggtccgcctcagtctcccaaagtgctgaggttacaggcgtgagccactgcgcccggctggcatttcctaccttactccatagtaaaatagtaagtgttggcttctcagaattgccagcagtccatgtgttatatgtgtatgtaattgctatttgcttttcttcccaaaacatacagaattagagtgaatagtataataaattgaactccccatgtacccatgcccaatttagcaatattagcacatagtcaatattatttcctctgtatcccttccattattttgaagcaattctgttattgtcaaccttaaagcggtcattgtatatctgtaaaatacaaggactttaaaaaaaaaaacatagccgaccgggcatgggtgggtcacctgtaaatctcaacattgggaggccaaggcagggcagatccacttgagggccagggagttcgagaccagcctggccaacatggtgaaaccctgtctct

SEQ ID NO: 91587 - DNA, 602 bp, Homo sapiens
cttttttctttagatttctctctcttgaacatcttttttcaataatgcctttgccatctcttgtcttataccttaaggcccaatccttgaccctctgttttttatcctatactcattattctgaaagagctaatttattcacaggaatcattagctctaatctcatgtgagttaaatcttcagactcaacttttaaaaacaatctcatctgtccctctaaaaattagcttcctttagaacctcttctccttggcaatatattagtgatactattgttatcttcacactaaagattcaaaactttagtttttgttttaggaaagttttttatttttacatttctttcatccttcataattacccagtcatcatgaactttgtagttatctatttcttcattaagaatccttgaggcctaggtgggcggatcatgaggtcaggagttcgagaccagcctggccaacagtgaaatcccatctctactaaaaatacaaaaattagccgggtgtggtagtgggcgcctgttgtcccagctattcaggaggctgagatggaagaatcgcttgaacccgggaggcagaggttgcagtgagctgagatca

SEQ ID NO: 91588 - DNA, 219 bp, Homo sapiens
gttggatacaaaaggctgcagaaaaagcacatattgaatgacctagagtgctctcctaggtttccagtaacccattttgaatctcactttgcctttccctttctcttaccttacctacatttgatgaagctggaattaggtacaatatatggaaataatttttctaattaaagtatttataaataataaagccctcacatttggaattatgattatgac

SEQ ID NO: 91589 - DNA, 324 bp, Homo sapiens
ggtgtctgccctataaaggagggaaattagtggcaggtggtgggaatattccaggcagctggggcaaagtgcttggccctcatttctgaaacctaatgctttagctttccttttccaacgtcaaacgaaagtgccaaagacagggctttgaggatgcctacactttgcacttgggaagaggagttaccacaacaatggtgagagaagactaatatggagaaaattgcagcagtctccagggctctagaaaacacaggaggaacctcccaaaggcctcataacatgcttcctgcatgggaagaggcaagaatagaagggaagaga

SEQ ID NO: 91590 - DNA, 166 bp, Homo sapiens
ccttccctaacatccacaccctttgctcttccccaccgcaggacccagctctcattcctttgcagcgtttatcaaactgtgcaagtactgtgttcatctgctgacttgttcctgtgttgaaacatgggccccatgagggagggactgggcctgacacatttgccac

SEQ ID NO: 91591 - DNA, 246 bp, Homo sapiens
cgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggt

SEQ ID NO: 91592 - DNA, 564 bp, Homo sapiens
caagggaggctccacacaagaaggagaggagaactggttattggtgagaactagtactgtctaccacacaaatctagatctcttttgtgagccccagatctgtgcatccaactgctctctcaacatctttacctaaatgttccacaggcaccccaaacccaatgtgtccaaaattaaactcattattttttcccaatcctataaccccttattttatattatcaacattagttgatggatacaacgcaggaaacctagttattgccacatcccctctctctcttactttcctctcacacctaataaatgactagactcatcacctatctgctctacctcttccccatggccattgccgctattcagatcatcctagtttctcacttggaactctgcaacaccaaaggattcttcacccactgtctggcacctcaccagtcccccctacactctgttgcctaaacccaaatgtgcttgtgttagtcctcttcagcagtctttccattgcctatacgggtaaaatatgtttagggcccgccattacctggttttatctatcctctc

SEQ ID NO: 91593 - DNA, 509 bp, Homo sapiens
tgagccagtgtgtgtatagctttagagaggctggagaagtcttaccagctgcttctgggtgcagtttcactgataggtcaggtggtggccacaaagccattttctgcttttaggaccatctccagatgggcacctcagtgatgactgtaaatacttgtttcttctcccattctccccacaagtaatcctccctggttatctacacatattgctctttggaggctgataaaatagtgttccaggctttagacaaagaacacaactgacttcattctgactgcctcccttatgtaccatgaaagtaagagagagagagagagagagagcagcagagcttacagtctgtctataggtattttttctgtatcagaaagggagagatgtcatctttaagataggagttagggctaggcatgatgagaggccaaggcaggaagatcacttgaggccaggagtttgagatcagcctggtcaacatagcaacacttccgtctctacttaaaaaaaca

SEQ ID NO: 91594 - DNA, 335 bp, Homo sapiens
ccccagacctgctgggtcagagactctggggggcttggagagctgcgttttgtgagtcctccaggtgattctgagtcacactcaggtctgagatccaccagctgcagctgcgtgtggccgtcctgccgatcaactaccactatttatagcaagcattctgtgatccttcactcctgaaatgaaacccaagtgtacctgtaacacccacctacgcaggaactccaagtcagtacgatgccccaaccgcagtgaaatggagaaacgcacacctacgcaggaattccccccaagtcagtacgatgccccaacctcaatgaaacggagaaacgcacacc

SEQ ID NO: 91595 - DNA, 358 bp, Homo sapiens
  misc_feature (357)..(357): n is a, c, g, or t
ctagagatttttaaaattatagacaaataaatgttcaactttacgttaataatttgaaagcctagaggaaatggagaaagtgtccataaaaatattaaccctattgactccaggagaagtagaaaacctgaaaaagacctaagacccagctgatttagcagccacacttgtgtgattatgtgtttgtgtttgcttttattaacgcgtgttttgtggttaaatattagtttgaaataattttttaggctcaaaattttaaacaaggctgttttctttttgtttttgttttttgagatgggatcacttgaacccaggaggcagaggtttcagtgagccaagattgtgactgcattccanc

SEQ ID NO: 91596 - DNA, 213 bp, Homo sapiens
ggggctggggaagaggaagtggtgaggggacggcgggcacgcaggctttgccctaactcaaggagacagcattcgctactgaatgccccgctgcgttcaagtcccggagcgtgtttgttttgaaattgacaattgtcagatgcatgctgcttctagtctctcagagaagggggatttataaagctttgctgcctacgccgtggggtaggggtt

SEQ ID NO: 91597 - DNA, 776 bp, Homo sapiens
tgagatggagtcactctgtcgccgaggctggagggcagtggcgtgatctcggctcactgcaacctccgcctcccaaattcatgcaattctccctgcctcaacctcccaagtagccgggattacaggcgcccgccaccgtgcccggctaagttttgtattatttagcccggcccatatccaaatttaaagaaacaaaatttgttttaaaaattcctaccaaaaatataggcaactcaaaaaaaatatgggtggctgggcatggcggcccaacgcctgtaatctcagcactttgggaggctgaggcgggtggatcctttgaacccaggagtttgagactagcctgggtaacatggtgaaactccatctgtacaaaaaaagttagctgggcatggcggcccacacctgtagtcccagctacttgggaggctgaggtggaagtatcgcttgagcccaggaggtcaagactgcggtgagtcaagctcacaccactgcactccgcaaatgggtaaaagccttttcacaaaagatatacaaataaataatcatctgaaaggtgctcaacatcattatcaggtaaatgaaaattaaagccacaagaagatcactacacacctgatctgaatggctaaaaataaattgacaataccatcatgggatgaacatggagcaaatggaacttggacgcactgccagtagtaacatgattcaagcattttgaaaaattatttggtggtttctaataaatctaaatatatatacttgccctatgacccagc

SEQ ID NO: 91598 - DNA, 754 bp, Homo sapiens
aacccggaagcggatcgcgtggagtgaaggtcctaccacggcgcgtgagtttcgctctgccttggattaagtctgcacttcccaggtccccggcgcttctgcccctgggacgtgggatccccacggacctggaaattctcgcctgtcttcccttcacccagagcaaattgagacgtcccgaggaagaccaaggcagcctattgggccttccaggcaatcacatgggaatcagccacacgtccttcctcctcacctcagaacatctcagaataacttggtgaaatgtctcccactgtgagcctcagtgagcccacctgtaacatagaggcctcgcccctgagctctacaatcctgtgtccagttgtctcctcagctgtctcctgggtcatcaaacaggcatccccaccttcaggtgtccacgagtggctttctaaacccccaaacacatttccttgcagtctgcacatctcagatgagggtgactacgtacttccggaaacggccgaacttgacagcatgtattttaaatttgtgaaataaattactttatttgtacacacaaaaacaaaaaaaaaaatgggaggaactcatagggggggggcggaaaaaacaaggtcaatggaattggccccaagggtccataagcgcggttccgggacccggttttctggtccaagggggaaaattgcgcggccccctataggggccgaataaattccgtaagccgggtaacctgcttagattgtcgcaaagc

SEQ ID NO: 91599 - DNA, 606 bp, Homo sapiens
aacccggaagcggatcgcgtggagtgaaggtcctaccacggcgcgtgagtttcgctctgccttggattaagtctgcacttcccaggtccccggcgcttctgcccctgggacgtgggatccccacggacctggaaattctcgcctgtcttcccttcacccagagcaaattgagacgtcccgcctcgcccctgagctctacaatcctgtgtccagttgtctcctcagctgtctcctgggtcatcaaacaggcatccccaccttcaggtgtccacgagtggctttctaaacccccaaacacatttccttgcagtctgcacatctcagatgagggtgactacgtacttccggaaacggccgaacttgacagcatgtattttaaatttgtgaaataaattactttatttgtacacacaaaaacaaaaaaaaaaatgggaggaactcatagggggggggcggaaaaaacaaggtcaatggaattggccccaagggtccataagcgcggttccgggacccggttttctggtccaagggggaaaattgcgcggccccctataggggccgaataaattccgtaagccgggtaacctgcttagattgtcgcaaagc

SEQ ID NO: 91600 - DNA, 751 bp, Homo sapiens
aacccggaagcggatcgcgtggagtgaaggtcctaccacggcgcgtgagtttcgctctgccttggattaagtctgcacttcccaggtccccggcgcttctgcccctgggacgtgggatccccacggacctggaaattctcgcctgtcttcccttcacccagagcaaattgagacgtcccggtaagagtctggaagttgcttgcttttgggtttgaagtcgctcggaggctggtcccgtccccggtctttctgctatagggcaatgtatacacttcctatcgcgtatttttcctgctcaaaacatttttctgactattcccgccccgtgctttttaaagtcctcacccgcgaggtggattccagccctgggcgcctcccagcctcgccccagttggcacctggagcgcggcgccccgccccagccccggggaggctgcgtcctctgcctggtcctgggatcctgcaggtcccacctttgtcttagggtgccgtcgcccaccacgtccctcctggtgccgggccctgctgctccccaagtcttcgcttcccctgagccagggttggggtgggtcgcaggggcttgtcctatgataccaggtgttctttcctgtccagctccaccccctggaaaatgcgcttctacgggatgcaggcgtcttactccaaacccgcctgtgattactccaaacccgcctgggccaaagggatcaggagatagagagagggactgagagagcagtagaaaaccaga

SEQ ID NO: 91601 - DNA, 358 bp, Homo sapiens
aacccggaagcggatcgcgtggagtgaaggtcctaccacggcgcgtgagtttcgctctgccttggattaagtctgcacttcccaggtccccggcgcttctgcccctgggacgtgggatccccacggacctggaaattctcgcctgtcttcccttcacccagagcaaattgagacgtcccggagaagaccaaggcagctattggccttcagcaatcacatgggatcagccaacgtcttctctactagacattagatacttgtgaatgctccatgtgagctagtagccccttaataagggggatagccgaagtattagtaaatccctaatgctaaaataagttttcttttttgggggggt

SEQ ID NO: 91602 - DNA, 358 bp, Homo sapiens
taaatttcaaatatccattctgctatgtacttctccacttcaaaatctttctatgttttcttaaagttttttgaaaaaattacttatattctcaagtagaaactggttcaaatgtatacccttgctttagagtcttgatacctttattctgacccttaaacctaatgacaaaaaaatcccttctttatctaaaattccttcctactaacacagctttattttttttaaatagagtagtttatctaaaattccttcctactaacacagctttattattttttatatagagtttctacaaatacatgatttaacattgtcatgcaccacatgacatttcaatgacaaatcacatgtatga
